United States Patent
Dhar et al.

(10) Patent No.: US 11,639,501 B2
(45) Date of Patent: May 2, 2023

(54) MODIFIED RIBONUCLEIC ACIDS AND USES THEREOF

(71) Applicant: Helix Nanotechnologies, Inc., Walnut, CA (US)

(72) Inventors: Nikhil Dhar, Boston, MA (US); Marianna Keaveney, Walpole, MA (US); Kyle Backman, Arlington, MA (US); Everett Webster, North Andover, MA (US); Nikolai Eroshenko, Boston, MA (US); Justin Quinn, Malden, MA (US)

(73) Assignee: Helix Nanotechnologies, Inc., Boston, MA (US)

( * ) Notice: Subject to any disclaimer, the term of this patent is extended or adjusted under 35 U.S.C. 154(b) by 0 days.

(21) Appl. No.: 17/736,966

(22) Filed: May 4, 2022

(65) Prior Publication Data

US 2022/0372477 A1    Nov. 24, 2022

Related U.S. Application Data

(60) Provisional application No. 63/273,031, filed on Oct. 28, 2021, provisional application No. 63/185,925, filed on May 7, 2021.

(51) Int. Cl.
*C07H 21/04* (2006.01)
*C12N 15/113* (2010.01)
*C12N 15/117* (2010.01)

(52) U.S. Cl.
CPC .......... *C12N 15/113* (2013.01); *C12N 15/117* (2013.01); *C12N 2310/141* (2013.01); *C12N 2310/334* (2013.01); *C12N 2310/335* (2013.01)

(58) Field of Classification Search
None
See application file for complete search history.

(56) References Cited

FOREIGN PATENT DOCUMENTS

| WO | WO-2014/093924 A1 | 6/2014 |
|----|-------------------|--------|
| WO | WO-2019/053609 A1 | 3/2019 |
| WO | WO-2020/077227 A2 | 4/2020 |
| WO | WO-2022/235838 A1 | 11/2022 |

OTHER PUBLICATIONS

Tsai, Kevin, et al. "Acetylation of cytidine residues boosts HIV-1 gene expression by increasing viral RNA stability." Cell host & microbe 28.2 (2020): 306-312.*
Arango, A. et al., Acetylation of Cytidine in mRNA Promotes Translation Efficiency, Cell, 175(7):1872-1886 (2018).
Damase. T. R. et al., The Limitless Future of RNA Therapeutics, Front. Bioeng. Biotechnol., 9:628137 (2021).
Schnell, G. et al., Uridine composition of the poly-U/UC tract of HCV RNA defines non-self recognition by RIG-I, PLoS Pathogen, 8(8):e1002839 (2012).
Svitkin, Y. V. et al., N1-methyl-pseudouridine in mRNA enhances translation through eIF2?-dependent and independent mechanisms by increasing ribosome density, NAR, 45(10):6023-6036 (2017).
Del Arco Jon et al., Enzymatic Production of Non-Natural Nucleoside-5'-Monophosphates by a Thermostable Uracil Phosphoribosyltransferase, CHEMCATCHEM, 10(2): 439-448 (2018).
Montagu M. et al., Preparation of Cytidine, Cytidylic Acids and Ribonucleic Acid Specifically Acetylated in the Exocyclic Amino Group of Cytosine, Bulletin Des Societes Chimiques Belges Vlaamse Chemische Vereniging, 77(3-4): 171-179 (1968).
Scheit Karl Heinz et al., Die Synthese der 5'-Diphosphate von 5-Methyl-uridin, 5-Hydroxymethyl-uridin und 3.5-Dimethyl-uridin, Chemische Berichte, 99(12): 3884-3891 (1966).

* cited by examiner

*Primary Examiner* — Kimberly Chong
(74) *Attorney, Agent, or Firm* — Choate, Hall & Stewart LLP; Stephanie L. Schonewald; Mandeep Kaur

(57) ABSTRACT

Disclosed herein is a modified ribonucleotide comprising a nucleoside comprising N4-acetylcytidine and/or 5-hydroxymethyluridine, and polyribonucleotides comprising the same. Also provided herein are compositions comprising a polyribonucleotide of the present disclosure and methods of making and using the same.

30 Claims, 31 Drawing Sheets

Specification includes a Sequence Listing.

| Condition | Significantly elevated serum cytokines* | Significantly reduced serum cytokines* |
|---|---|---|
| 1 ug unmodified Luc2 37C | IFNy, IP-10 | IL-9 |
| 1 ug 100% Ac4C Luc2 37C | - | - |
| 1 ug 100% mPseudo Luc2 37 C | IP-10 | - |
| *95% confidence interval compared to PBS/Untreated condition | | |

FIG. 7

SEQUENCE LISTING

```
<160> NUMBER OF SEQ ID NOS: 4

<210> SEQ ID NO 1
<211> LENGTH: 78
<212> TYPE: DNA
<213> ORGANISM: Artificial Sequence
<220> FEATURE:
<223> OTHER INFORMATION: Description of Artificial Sequence: Synthetic
      primer

<400> SEQUENCE: 1 cttgttctttt ttgcagaagc tcagaataaa cgctcaactt tggccaccat ggaagatgcc      60
aaaaacatta agaagggc                                                    78

<210> SEQ ID NO 2
<211> LENGTH: 157
<212> TYPE: DNA
<213> ORGANISM: Artificial Sequence
<220> FEATURE:
<223> OTHER INFORMATION: Description of Artificial Sequence: Synthetic
      primer

<400> SEQUENCE: 2
agaatgtgaa gaaactttct ttttattagg agcagatacg aatggctaca ttttggggga      60
caacattttg taaagtgtaa gttggtatta tgtagcttag agactccatt cgggtgttct     120
tgaggctggt ctatcattac acggcgatct tgccgcc                              157
```

```
<210> SEQ ID NO 3
<211> LENGTH: 45
<212> TYPE: DNA
<213> ORGANISM: Artificial Sequence
<220> FEATURE:
<223> OTHER INFORMATION: Description of Artificial Sequence: Synthetic
      primer

<400> SEQUENCE: 3
gaatttaata cgactcacta taaggcttgt tcttttttgca gaagc                45

<210> SEQ ID NO 4
<211> LENGTH: 149
<212> TYPE: DNA
<213> ORGANISM: Artificial Sequence
<220> FEATURE:
<223> OTHER INFORMATION: Description of Artificial Sequence: Synthetic
      primer

<400> SEQUENCE: 4
tttttttttt tttttttttt tttttttttt tttttttttt tttttttttt tttttttttt     60
tttttttttt tttttttttt tttttttttt tttttttttt tttttttttt tttttttttt    120
agaatgtgaa gaaactttct ttttattag                                      149
```

MODIFIED RIBONUCLEIC ACIDS AND USES THEREOF

CROSS-REFERENCE TO RELATED APPLICATIONS

This application claims priority to U.S. Provisional Patent Application 63/185,925 filed on May 7, 2021, and U.S. Provisional Patent Application 63/273,031 filed on Oct. 28, 2021, the entire contents of each of which is hereby incorporated by reference.

Sequence Listing

The instant application contains a Sequence Listing which has been submitted electronically in ASCII format and is hereby incorporated by reference in its entirety. Said ASCII copy, created on Jun. 22, 2022, is named 2012611-0037_SL.txt and is 1,613 bytes in size.

BACKGROUND

RNA therapeutics is a new and emerging field.

SUMMARY

The present disclosure identifies certain challenges with the use of RNA as therapeutics. For example, in some embodiments, the present disclosure identifies certain problems that can be encountered with immunogenicity caused by administration of RNA therapeutics, which can hamper efforts in using higher doses or repeated dosing of RNA therapeutics. Immunogenicity caused by administration of RNA therapeutics in response to the RNA molecules themselves should be contrasted with immunogenicity caused by, e.g., polypeptides encoded by the RNA molecules, which may be desirable as a result of, e.g., an RNA vaccine. The present disclosure also identifies challenges related to payload expression that can be encountered by administration of RNA therapeutics. For example, currently used RNA therapeutic modalities typically do not provide high and/or sustained expression of payloads encoded by the RNA.

Among other things, the present disclosure provides technologies for reducing immunogenicity of RNA therapeutics and/or increasing payload expression, by providing a polyribonucleotide comprising a modified ribonucleotide, e.g., as disclosed herein. In some embodiments, a modified ribonucleotide comprises a ribonucleotide comprising N4-acetylcytidine and/or a ribonucleotide comprising 5-hydroxymethyluridine. Without wishing to be bound by theory, the present disclosure proposes that a polyribonucleotide comprising N4-acetylcytidine and/or 5-hydroxymethyluridine can achieve reduced immunogenicity when administered in a cell, tissue or subject by reduced activation of an innate immune response. In some embodiments, reduced activation of an innate immune response, e.g., reduced activation of NF-kb or an NF-kb pathway, IRF or an IRF pathway, and/or other inflammatory cytokines; or reduced detection of uncapped RNA by a molecular sensor (e.g., RIG-I), with a polyribonucleotide comprising N4-acetylcytidine and/or 5-hydroxymethyluridine, or a composition comprising the same allows for repeated dosing of, e.g., at least two doses of, said polyribonucleotide or a composition comprising the same. In some embodiments, a polyribonucleotide comprising N4-acetylcytidine and/or 5-hydroxymethyluridine, or a composition comprising the same can be administered at a higher dose compared to a reference polyribonucleotide that includes: (i) fewer acetyl groups on a nucleobase (e.g., does not include any acetyl groups on a nucleobase); and/or (ii) fewer hydroxymethyl groups (e.g., does not includes any hydroxymethyl groups).

The present disclosure is the first to report the insight that N4-acetylcytidine and 5-hydroxymethyluridine residues can interact synergistically in polyribonucleotides to reduce immunogenicity, increase cell viability, and/or increase expression of proteins or polypeptides when administered in a cell, tissue or subject. In particular, the present disclosure provides the insight that polyribonucleotides comprising both N4-acetylcytidine and 5-hydroxymethyluridine residues have higher payload expression and reduced immunogenicity, as compared to polyribonucleotides comprising either modification alone. For example, in some embodiments, a polyribonucleotide comprising 5-hydroxymethyluridine residues has increased payload expression. As another example, a polyribonucleotide comprising N4-acetylcytidine has reduced immunogenicity. When combined, as shown in Example 3 herein, a polyribonucleotide comprising both N4-acetylcytidine and 5-hydroxymethyluridine residues has enhanced payload expression and significantly reduced immunogenicity.

The present disclosure further provides the insight that a polyribonucleotide comprising both N4-acetylcytidine and 5-hydroxymethyluridine residues can inhibit sensing of uncapped RNA. This insight is particularly useful as innate immune sensing of RNA remains a major barrier in using RNA in applications that involve repeat dosing and or/high dose regimens, including gene therapy and enzyme replacement.

Among other things, the present disclosure provides technologies for increasing expression from RNA therapeutics by providing a polyribonucleotide comprising a modified ribonucleotide, e.g., a ribonucleotide comprising a uridine nucleoside comprising one or more modifications and/or a ribonucleotide comprising a cytidine nucleoside comprising one or more modifications. In some embodiments, a modified ribonucleotide comprises a ribonucleotide comprising N4-acetylcytidine and/or a ribonucleotide comprising 5-hydroxymethyluridine. In some embodiments, a polyribonucleotide described herein encodes for a payload, e.g., as described herein. Without wishing to be bound by theory, the present disclosure proposes that a polyribonucleotide comprising N4-acetylcytidine and/or 5-hydroxymethyluridine can achieve increased levels payload expression when administered in a cell, tissue or subject.

Technologies provided herein for reducing immunogenicity of RNA therapeutics and/or increasing payload expression, are particularly useful for delivery of therapies such as antibody therapies, immune-modulation therapies, gene therapies and/or other therapies (e.g., as described herein), in which stability and/or shelf-life of the therapeutic formulation is important for therapeutic efficacy. For example, formulations of antibody therapeutics (e.g., antibody therapeutics, including antibodies, antibody fragments or alternative antibody formats) are generally time and/or temperature sensitive and may not very stable for prolonged periods of time. This results in degradation products from the antibody therapeutic that can be toxic and/or are not efficacious. Degradation of antibody therapeutic formulations can result in reduced expression, reduced efficacy, and even increased immunogenicity (e.g., from degradation products or breakdown of other formulation components) of the product when administered to a subject. When delivered to a subject, such antibody therapeutics or immune-modulation therapies have a short half-life and are rapidly cleared from the body, thus providing a limited therapeutic window. Furthermore, such antibody therapies, immune-modulation therapies, gene therapies and/or other therapies (e.g., as described herein) are often formulated in a manner such that repeated delivery is not feasible and/or is undesirable (e.g., due to inconvenience, inability of a subject to be dosed repeatedly, or other related factors).

In contrast, administration of a polyribonucleotide disclosed herein provides persistent, continuous, and/or high expression of a therapeutic, and can further allow for repeated dosing of a therapeutic (e.g., an antibody therapy, immune-modulation therapy, gene therapy and/or other therapy (e.g., as described herein)). Polyribonucleotides disclosed herein are not subject to the challenges of other therapeutics (for example antibody therapeutics) such as degradation products in a therapeutic formulation and/or inability to be repeatedly dosed because the therapeutic is produced in, e.g., a cell or a subject. This provides a particular benefit for using a polyribonucleotide disclosed herein when administering a therapeutic product for at least the reason that a polyribonucleotide delivers a therapeutic product in the form of an RNA and said RNA is translated into a corresponding therapeutic product in vivo.

The technologies disclosed herein relate to, among other things, polyribonucleotide structures, e.g., modifications, and benefits of said modifications, e.g., to reduce immunogenicity and/or increase payload expression. Benefits associated with polyribonucleotides disclosed herein are not limited by payload. Instead, polyribonucleotides disclosed herein can be used with any payload or a plurality of payloads, to provide benefits of, e.g., reduced immunogenicity and/or increase payload expression.

Accordingly, the present disclosure further provides the recognition that polyribonucleotides comprising N4-acetylcytidine and/or 5-hydroxymethyluridine residues can work well in a number of therapeutic compositions, including gene therapies, antibody therapies, immune-modulation therapies, and vaccines.

The present disclosure further provides the insight that the inclusion of N4-acetylcytidine and/or 5-hydroxymethyluridine in a polyribonucleotide can inhibit recognition of uncapped RNA (e.g., mRNAs) by a subject's immune system, e.g., by RIG-I sensing.

Also provided herein are compositions comprising a polyribonucleotide comprising N4-acetylcytidine and/or 5-hydroxymethyluridine, and methods of making and using the same.

The present disclosure provides a modified ribonucleotide comprising a nucleoside comprising an acetyl group, wherein the nucleoside is N4-acetylcytidine and the modified ribonucleotide has: (a) a 5' monophosphate; (b) a 5' diphosphate; or (c) a 5' triphosphate.

In some embodiments, a modified ribonucleotide comprises N4-acetylcytidine and has a structure of:

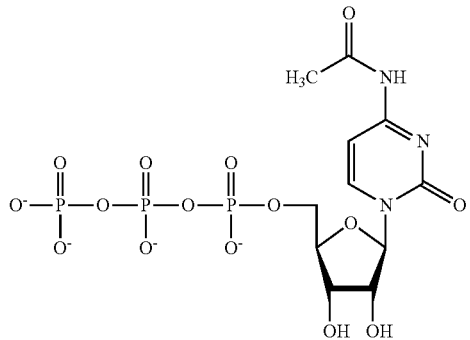

Also provided herein is a polyribonucleotide comprising one or more modified ribonucleotides disclosed herein, e.g., comprising a nucleoside comprising an acetyl group, wherein the nucleoside is N4-acetylcytidine.

In some embodiments, a polyribonucleotide comprises cytidine residues, wherein at least 5% of cytidine residues in a polyribonucleotide comprise N4-acetylcytidine.

In some embodiments, a polyribonucleotide comprises cytidine residues, wherein less than 100% of cytidine residues in a polyribonucleotide comprise N4-acetylcytidine.

In some embodiments, a polyribonucleotide comprises cytidine residues and about 5% to 99%, about 5% to 95%, about 5% to 90%, about 5% to 85%, about 5% to 80%, about 5% to 75%, about 5% to 70%, about 5% to 65%, about 5% to 60%, about 5% to 55%, about 5% to 50%, about 5% to 45%, about 5% to 40%, about 5% to 35%, about 5% to 30%, about 5% to 25%, about 5% to 20%, about 5% to 15%, about 5% to 10%, about 10% to 99%, about 15% to 99%, about 20% to 99%, about 25% to 99%, about 30% to 99%, about 35% to 99%, about 40% to 99%, about 45% to 99%, about 50% to 99%, about 55% to 99%, about 60% to 99%, about 65% to 99%, about 70% to 99%, about 80% to 99%, about 85% to 99%, about 90% to 99%, or about 95% to 99% of cytidine residues in a polyribonucleotide comprise N4-acetylcytidine.

In some embodiments, a polyribonucleotide comprises cytidine residues and about 5%, about 10%, about 15%, about 20%, about 25%, about 30%, about 35%, about 40%, about 45%, about 50%, about 55%, about 60%, about 65%, about 70%, about 75%, about 80%, about 85%, about 90%, about 95%, or about 99% of cytidine residues in a polyribonucleotide comprise N4-acetylcytidine.

In some embodiments, a polyribonucleotide comprises cytidine residues and at least 5%, at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, or at least 99% of cytidine residues in a polyribonucleotide comprise N4-acetylcytidine.

In some embodiments, a polyribonucleotide comprises cytidine residues and more than 60% of cytidine residues in a polyribonucleotide comprise N4-acetylcytidine.

In some embodiments, a polyribonucleotide comprises cytidine residues and about 60-100%, about 65%-100%, about 70%-100%, about 75%-100%, about 80%-100%, about 85%-100%, about 90%-100%, about 95%-100%, about 60%-95%, about 60%-90%, about 60%-85%, about 60%-80%, about 60%-75%, about 60%-70%, about 60%-65% of cytidine residues in a polyribonucleotide comprise N4-acetylcytidine.

In some embodiments, a polyribonucleotide comprising N4-acetylcytidine further comprises one or more modified ribonucleotides other than N4-acetylcytidine. In some embodiments, one or more modified ribonucleotides comprises a nucleoside chosen from: an adenosine, a guanosine, a cytidine or a uridine, or a combination thereof. In some embodiments, one or more modified ribonucleotides comprises a hydroxymethyl group. In some embodiments, a nucleoside of one or more modified ribonucleotides is 5-hydroxymethyluridine. In some embodiments, a polyribonucleotide comprising 5-hydroxymethyluridine has: (a) a 5' monophosphate; (b) a 5' diphosphate; or (c) a 5' triphosphate.

In some embodiments, a polyribonucleotide comprising N4-acetylcytidine further comprises uridines with about 5%-100% of uridines substituted with 5-hydroxymethyluridine.

The present disclosure provides a modified ribonucleotide comprising a nucleoside comprising a hydroxymethyl group, wherein the nucleoside is 5-hydroxymethyluridine and the modified ribonucleotide has: (a) a 5' monophosphate; (b) a 5' diphosphate; or (c) a 5' triphosphate and a structure of:

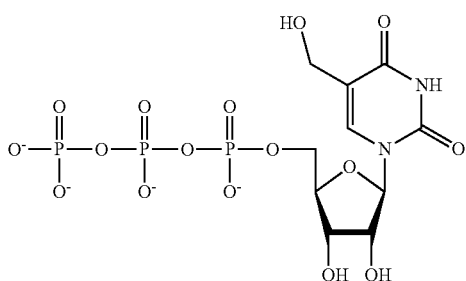

Also provided herein is a polyribonucleotide comprising one or more modified ribonucleotides disclosed herein, e.g., comprising a nucleoside comprising an hydroxymethyl group, wherein the nucleoside is 5-hydroxymethyluridine.

In some embodiments, a polyribonucleotide comprises uridine residues, wherein at least 5% of uridine residues in a polyribonucleotide comprise 5-hydroxymethyluridine.

In some embodiments, a polyribonucleotide comprises uridine residues, wherein less than 100% of uridine residues in a polyribonucleotide comprise 5-hydroxymethyluridine.

In some embodiments, a polyribonucleotide comprises uridine residues and about 5% to 99%, about 5% to 95%, about 5% to 90%, about 5% to 85%, about 5% to 80%, about 5% to 75%, about 5% to 70%, about 5% to 65%, about 5% to 60%, about 5% to 55%, about 5% to 50%, about 5% to 45%, about 5% to 40%, about 5% to 35%, about 5% to 30%, about 5% to 25%, about 5% to 20%, about 5% to 15%, about 5% to 10%, about 10% to 99%, about 15% to 99%, about 20% to 99%, about 25% to 99%, about 30% to 99%, about 35% to 99%, about 40% to 99%, about 45% to 99%, about 50% to 99%, about 55% to 99%, about 60% to 99%, about 65% to 99%, about 70% to 99%, about 80% to 99%, about 85% to 99%, about 90% to 99%, or about 95% to 99% of uridine residues in a polyribonucleotide comprise 5-hydroxymethyluridine.

In some embodiments, a polyribonucleotide comprises uridine residues and about 5%, about 10%, about 15%, about 20%, about 25%, about 30%, about 35%, about 40%, about 45%, about 50%, about 55%, about 60%, about 65%, about 70%, about 75%, about 80%, about 85%, about 90%, about 95%, or about 99% of uridine residues in a polyribonucleotide comprise 5-hydroxymethyluridine.

In some embodiments, a polyribonucleotide comprises uridine residues and at least 5%, at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, or at least 99% of uridine residues in a polyribonucleotide comprise 5-hydroxymethyluridine.

In some embodiments, a polyribonucleotide comprises uridine residues and more than 60% of uridine residues in a polyribonucleotide comprise 5-hydroxymethyluridine.

In some embodiments, a polyribonucleotide comprises uridine residues and about 60-100%, about 65%-100%, about 70%-100%, about 75%-100%, about 80%-100%, about 85%-100%, about 90%-100%, about 95%-100%, about 60%-95%, about 60%-90%, about 60%-85%, about 60%-80%, about 60%-75%, about 60%-70%, about 60%-65% of uridine residues in a polyribonucleotide comprise 5-hydroxymethyluridine.

In some embodiments, a polyribonucleotide comprising 5-hydroxymethyluridine further comprises one or more additional modified ribonucleotides other than 5-hydroxymethyluridine. In some embodiments, one or more additional modified ribonucleotides comprises a nucleoside chosen from: an adenosine, a guanosine, a cytidine or a uridine, or a combination thereof. In some embodiments, one or more additional modified ribonucleotides comprises an acetyl group. In some embodiments, a nucleoside of one or more additional modified ribonucleotides is N4-acetylcytidine.

In some embodiments, a polyribonucleotide comprising 5-hydroxymethyluridine further comprises cytidines with about 5%-100% of cytidines substituted with N4-acetylcytidine.

The present disclosure provides a polyribonucleotide comprising one or more modified ribonucleotides, wherein the one or more modified ribonucleotides comprises one, or both of:

(i) 5-hydroxymethyluridine, and (a) a 5' monophosphate; (b) a 5' diphosphate; or (c) a 5' triphosphate, and a structure of:

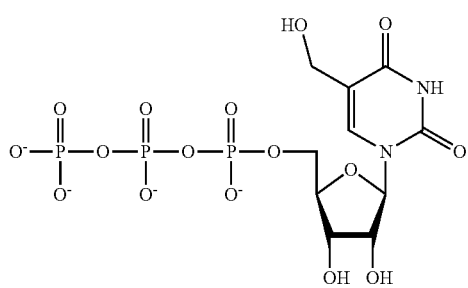

(ii) N4-acetylcytidine, and (a) a 5' monophosphate; (b) a 5' diphosphate; or (c) a 5' triphosphate, and a structure of:

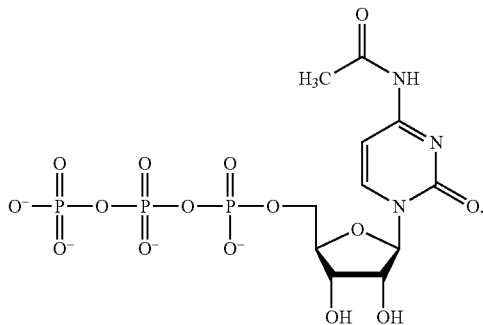

In some embodiments of a polynucleotide comprising cytidine and uridine residues: (a) at least 5% of cytidine residues in a polyribonucleotide comprise N4-acetylcytidine; and/or (b) at least 5% of uridine residues in a polyribonucleotide comprise 5-hydroxymethyluridine.

In some embodiments of a polynucleotide comprising cytidine and uridine residues: (a) less than 100% of cytidine residues in a polyribonucleotide comprise N4-acetylcytidine; and/or (b) less than 100% of uridine residues in a polyribonucleotide comprise 5-hydroxymethyluridine.

In some embodiments of a polynucleotide comprising cytidine and uridine residues: (a) about 5% to 99%, about 5% to 95%, about 5% to 90%, about 5% to 85%, about 5% to 80%, about 5% to 75%, about 5% to 70%, about 5% to 65%, about 5% to 60%, about 5% to 55%, about 5% to 50%, about 5% to 45%, about 5% to 40%, about 5% to 35%, about 5% to 30%, about 5% to 25%, about 5% to 20%, about 5% to 15%, about 5% to 10%, about 10% to 99%, about 15% to 99%, about 20% to 99%, about 25% to 99%, about 30% to 99%, about 35% to 99%, about 40% to 99%, about 45% to 99%, about 50% to 99%, about 55% to 99%, about 60% to 99%, about 65% to 99%, about 70% to 99%, about 80% to 99%, about 85% to 99%, about 90% to 99%, or about 95% to 99% of cytidine residues in a polyribonucleotide comprise N4-acetylcytidine; and/or (b) about 5% to 99%, about 5% to 95%, about 5% to 90%, about 5% to 85%, about 5% to 80%, about 5% to 75%, about 5% to 70%, about 5% to 65%, about 5% to 60%, about 5% to 55%, about 5% to 50%, about 5% to 45%, about 5% to 40%, about 5% to 35%, about 5% to 30%, about 5% to 25%, about 5% to 20%, about 5% to 15%, about 5% to 10%, about 10% to 99%, about 15% to 99%, about 20% to 99%, about 25% to 99%, about 30% to 99%, about 35% to 99%, about 40% to 99%, about 45% to 99%, about 50% to 99%, about 55% to 99%, about 60% to 99%, about 65% to 99%, about 70% to 99%, about 80% to 99%, about 85% to 99%, about 90% to 99%, or about 95% to 99% of uridine residues in the polyribonucleotide comprise 5-hydroxymethyluridine.

In some embodiments of a polynucleotide comprising cytidine and uridine residues: (a) about 5%, about 10%, about 15%, about 20%, about 25%, about 30%, about 35%, about 40%, about 45%, about 50%, about 55%, about 60%, about 65%, about 70%, about 75%, about 80%, about 85%, about 90%, about 95%, or about 99% of cytidine residues in a polyribonucleotide comprise N4-acetylcytidine; and/or (b) about 5%, about 10%, about 15%, about 20%, about 25%, about 30%, about 35%, about 40%, about 45%, about 50%, about 55%, about 60%, about 65%, about 70%, about 75%, about 80%, about 85%, about 90%, about 95%, or about 99% of uridine residues in a polyribonucleotide comprise 5-hydroxymethyluridine.

In some embodiments of a polynucleotide comprising cytidine and uridine residues: (a) at least 5%, at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, or at least 99% of cytidine residues in a polyribonucleotide comprise N4-acetylcytidine; and/or (b) at least 5%, at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, or at least 99% of uridine residues in a polyribonucleotide comprise 5-hydroxymethyluridine.

In some embodiments of a polynucleotide comprising cytidine and uridine residues: (a) more than 60% of cytidine residues in a polyribonucleotide comprise N4-acetylcytidine; and/or (b) more than 60% of uridine residues in a polyribonucleotide comprise 5-hydroxymethyluridine.

In some embodiments of a polynucleotide comprising cytidine and uridine residues: (a) about 60-100%, about 65%-100%, about 70%-100%, about 75%-100%, about 80%-100%, about 85%-100%, about 90%-100%, about 95%-100%, about 60%-95%, about 60%-90%, about 60%-85%, about 60%-80%, about 60%-75%, about 60%-70%, about 60%-65% of cytidine residues in a polyribonucleotide comprise N4-acetylcytidine; and/or (b) about 60-100%, about 65%-100%, about 70%-100%, about 75%-100%, about 80%-100%, about 85%-100%, about 90%-100%, about 95%-100%, about 60%-95%, about 60%-90%, about 60%-85%, about 60%-80%, about 60%-75%, about 60%-70%, about 60%-65% of uridine residues in a polyribonucleotide comprise 5-hydroxymethyluridine.

In some embodiments of a polynucleotide comprising cytidine and uridine residues: (a) about 60-100% of cytidine residues in a polyribonucleotide comprise N4-acetylcytidine; and (b) about 60-100% of uridine residues in a polyribonucleotide comprise 5-hydroxymethyluridine.

In some embodiments of a polynucleotide comprising cytidine and uridine residues: (a) at least about 60% of cytidine residues in a polyribonucleotide comprise N4-acetylcytidine; and (b) about 60-100% of uridine residues in a polyribonucleotide comprise 5-hydroxymethyluridine.

In some embodiments of a polynucleotide comprising cytidine and uridine residues: (a) at least about 70% of cytidine residues in a polyribonucleotide comprise N4-acetylcytidine; and (b) about 60-100% of uridine residues in a polyribonucleotide comprise 5-hydroxymethyluridine.

In some embodiments of a polynucleotide comprising cytidine and uridine residues: (a) at least about 75% of cytidine residues in a polyribonucleotide comprise N4-acetylcytidine; and (b) about 60-100% of uridine residues in a polyribonucleotide comprise 5-hydroxymethyluridine.

In some embodiments of a polynucleotide comprising cytidine and uridine residues: (a) at least about 80% of cytidine residues in a polyribonucleotide comprise N4-acetylcytidine; and (b) about 60-100% of uridine residues in a polyribonucleotide comprise 5-hydroxymethyluridine.

In some embodiments of a polynucleotide comprising cytidine and uridine residues: (a) at least about 85% of cytidine residues in a polyribonucleotide comprise N4-acetylcytidine; and (b) about 60-100% of uridine residues in a polyribonucleotide comprise 5-hydroxymethyluridine.

In some embodiments of a polynucleotide comprising cytidine and uridine residues: (a) at least about 90% of cytidine residues in a polyribonucleotide comprise N4-acetylcytidine; and (b) about 60-100% of uridine residues in a polyribonucleotide comprise 5-hydroxymethyluridine.

In some embodiments of a polynucleotide comprising cytidine and uridine residues: (a) at least about 95% of cytidine residues in a polyribonucleotide comprise N4-acetylcytidine; and (b) about 60-100% of uridine residues in a polyribonucleotide comprise 5-hydroxymethyluridine.

In some embodiments of a polynucleotide comprising cytidine and uridine residues: (a) at least about 99% of cytidine residues in a polyribonucleotide comprise N4-acetylcytidine; and (b) about 60-100% of uridine residues in a polyribonucleotide comprise 5-hydroxymethyluridine.

In some embodiments of a polynucleotide comprising cytidine and uridine residues: (a) about 100% of cytidine residues in a polyribonucleotide comprise N4-acetylcytidine; and (b) about 60-100% of uridine residues in a polyribonucleotide comprise 5-hydroxymethyluridine.

In some embodiments of a polynucleotide comprising cytidine and uridine residues: (a) about 60-100% of cytidine residues in a polyribonucleotide comprise N4-acetylcytidine; and (b) at least about 60% of uridine residues in a polyribonucleotide comprise 5-hydroxymethyluridine.

In some embodiments of a polynucleotide comprising cytidine and uridine residues: (a) about 60-100% of cytidine residues in a polyribonucleotide comprise N4-acetylcytidine; and (b) at least about 70% of uridine residues in a polyribonucleotide comprise 5-hydroxymethyluridine.

In some embodiments of a polynucleotide comprising cytidine and uridine residues: (a) about 60-100% of cytidine residues in a polyribonucleotide comprise N4-acetylcytidine; and (b) at least about 75% of uridine residues in a polyribonucleotide comprise 5-hydroxymethyluridine.

In some embodiments of a polynucleotide comprising cytidine and uridine residues: (a) about 60-100% of cytidine residues in a polyribonucleotide comprise N4-acetylcytidine; and (b) at least about 80% of uridine residues in a polyribonucleotide comprise 5-hydroxymethyluridine.

In some embodiments of a polynucleotide comprising cytidine and uridine residues: (a) about 60-100% of cytidine residues in a polyribonucleotide comprise N4-acetylcytidine; and (b) at least about 85% of uridine residues in a polyribonucleotide comprise 5-hydroxymethyluridine.

In some embodiments of a polynucleotide comprising cytidine and uridine residues: (a) about 60-100% of cytidine residues in a polyribonucleotide comprise N4-acetylcytidine; and (b) at least about 90% of uridine residues in a polyribonucleotide comprise 5-hydroxymethyluridine.

In some embodiments of a polynucleotide comprising cytidine and uridine residues: (a) about 60-100% of cytidine residues in a polyribonucleotide comprise N4-acetylcytidine; and (b) at least about 95% of uridine residues in a polyribonucleotide comprise 5-hydroxymethyluridine.

In some embodiments of a polynucleotide comprising cytidine and uridine residues: (a) about 60-100% of cytidine residues in a polyribonucleotide comprise N4-acetylcytidine; and (b) at least about 99% of uridine residues in a polyribonucleotide comprise 5-hydroxymethyluridine.

In some embodiments of a polynucleotide comprising cytidine and uridine residues: (a) about 60-100% of cytidine residues in a polyribonucleotide comprise N4-acetylcytidine; and (b) about 100% of uridine residues in a polyribonucleotide comprise 5-hydroxymethyluridine.

In some embodiments of a polynucleotide comprising cytidine and uridine residues: (a) at least about 60% of cytidine residues in a polyribonucleotide comprise N4-acetylcytidine; and (b) at least about 60% of uridine residues in a polyribonucleotide comprise 5-hydroxymethyluridine.

In some embodiments of a polynucleotide comprising cytidine and uridine residues: (a) at least about 70% of cytidine residues in a polyribonucleotide comprise N4-acetylcytidine; and (b) at least about 70% of uridine residues in a polyribonucleotide comprise 5-hydroxymethyluridine.

In some embodiments of a polynucleotide comprising cytidine and uridine residues: (a) at least about 75% of cytidine residues in a polyribonucleotide comprise N4-acetylcytidine; and (b) at least about 75% of uridine residues in a polyribonucleotide comprise 5-hydroxymethyluridine.

In some embodiments of a polynucleotide comprising cytidine and uridine residues: (a) at least about 80% of cytidine residues in a polyribonucleotide comprise N4-acetylcytidine; and (b) at least about 80% of uridine residues in a polyribonucleotide comprise 5-hydroxymethyluridine.

In some embodiments of a polynucleotide comprising cytidine and uridine residues: (a) at least about 85% of cytidine residues in a polyribonucleotide comprise N4-acetylcytidine; and (b) at least about 85% of uridine residues in a polyribonucleotide comprise 5-hydroxymethyluridine.

In some embodiments of a polynucleotide comprising cytidine and uridine residues: (a) at least about 90% of cytidine residues in a polyribonucleotide comprise N4-acetylcytidine; and (b) at least about 90% of uridine residues in a polyribonucleotide comprise 5-hydroxymethyluridine.

In some embodiments of a polynucleotide comprising cytidine and uridine residues: (a) at least about 95% of cytidine residues in a polyribonucleotide comprise N4-acetylcytidine; and (b) at least about 95% of uridine residues in a polyribonucleotide comprise 5-hydroxymethyluridine.

In some embodiments of a polynucleotide comprising cytidine and uridine residues: (a) at least about 99% of cytidine residues in a polyribonucleotide comprise N4-acetylcytidine; and (b) at least about 99% of uridine residues in a polyribonucleotide comprise 5-hydroxymethyluridine.

In some embodiments of a polynucleotide comprising cytidine and uridine residues: (a) about 100% of cytidine residues in a polyribonucleotide comprise N4-acetylcytidine; and (b) about 100% of uridine residues in a polyribonucleotide comprise 5-hydroxymethyluridine.

In some embodiments, a polyribonucleotide disclosed herein is characterized in that when assessed in a cell, tissue or an organism that has been administered a polyribonucleotide, reduced immunogenicity is observed relative to an appropriate reference comparator.

In some embodiments, a reference comparator comprises an otherwise similar cell, tissue or organism that has been administered a comparable polyribonucleotide that includes: (i) fewer acetyl groups on a nucleobase (e.g., does not include any acetyl groups on a nucleobase) than a polyribonucleotide in a composition; and/or (ii) fewer hydroxymethyl groups (e.g., does not includes any hydroxymethyl groups) than a polyribonucleotide in a composition. In some embodiments, a comparable polynucleotide comprises fewer (e.g., does not include) N4-acetylcytidine and/or fewer (e.g., does not include) 5-hydroxymethyluridine compared to a polyribonucleotide in a composition disclosed herein.

In some embodiments, reduced immunogenicity comprises reduced activation of an innate immune response induced toxicity. In some embodiments, reduced activation of an immune response comprises reduced activation of NF-kb or an NF-kb pathway; IRF or an IRF pathway; and/or other inflammatory cytokines in a cell, tissue or organism. In some embodiments, reduced activation of an immune response comprises reduced detection of uncapped RNA by a molecular sensor, e.g., RIG-I. In some embodiments, an uncapped RNA comprises an RNA without a cap structure, e.g. as described herein. In some embodiments, an uncapped RNA comprises an RNA with a 5' phosphate group and/or a hydroxyl group.

In some embodiments, a polyribonucleotide disclosed herein is characterized in that when assessed in a cell, tissue or an organism that has been administered a polyribonucleotide, increased expression of a payload is observed relative to an appropriate reference comparator. In some embodiments, a reference comparator comprises an otherwise similar cell, tissue or organism that has been administered a comparable polyribonucleotide that includes: (i) fewer N4-acetylcytidine nucleosides (e.g., does not include any N4-acetylcytidine nucleosides); and/or (ii) fewer 5-hydroxymethyluridine nucleosides (e.g., does not include any 5-hydroxymethyluridine nucleosides).

In some embodiments, increase in expression of a payload is about 1.2-fold, about 1.5-fold, about 2-fold, about 4-fold, about 5-fold, about 10-fold or about 20-fold compared to the reference comparator.

In some embodiments, increase in expression of a payload is about 1.2 fold to about 20-fold, about 1.5-fold to about 20-fold, about 2-fold to about 20-fold, about 4-fold to about 20-fold, about 5-fold to about 20-fold, about 10-fold to about 20-fold, about 1.2-fold to about 10-fold, about 1.2-fold to about 5-fold, about 1.2-fold to about 4-fold, about 1.2-fold to about 2-fold, or about 1.2-fold to about 1.5-fold.

In some embodiments, a payload is or comprises a polypeptide encoded by a polyribonucleotide comprising one or more modified ribonucleotides, e.g., as described herein.

In some embodiments, a payload is or comprises a polyribonucleotide situated in a polyribonucleotide comprising one or more modified ribonucleotides, e.g., as described herein.

In some embodiments, reduced immunogenicity allows for repeated dosing, e.g., two or more doses, of a polyribonucleotide. In some embodiments, repeated dosing comprises two, three, four, five, six, seven, eight, nine, or ten doses of a polyribonucleotide. In some embodiments, repeated dosing comprises a same dose of a polyribonucleotide as compared to a previous dose. In some embodiments, repeated dosing comprises a different dose of a polyribonucleotide as compared to a previous dose.

In some embodiments, reduced immunogenicity allows for administration of a higher dose of a polyribonucleotide related to an appropriate reference comparator. In some embodiments, a reference comparator comprises a comparable polyribonucleotide which includes: (i) fewer acetyl groups on a nucleobase (e.g., does not include any acetyl groups on a nucleobase) and/or (ii) fewer hydroxymethyl group (e.g., does not includes any hydroxymethyl groups) than a polyribonucleotide in a composition disclosed herein. In some embodiments, a comparable polynucleotide comprises fewer (e.g., does not include) N4-acetylcytidine and/or fewer (e.g., does not include) 5-hydroxymethyluridine compared to a polyribonucleotide in a composition disclosed herein. In some embodiments, a polyribonucleotide disclosed herein is characterized in that when assessed in a cell, tissue or an organism that has been administered a polyribonucleotide, increased cell viability is observed relative to an appropriate reference comparator. In some embodiments, a reference comparator is a cell viability of a cell, tissue or organism that has been administered a comparable polyribonucleotide that includes: (i) fewer acetyl groups on a nucleobase (e.g., does not include any acetyl groups on a nucleobase) and/or (ii) fewer hydroxymethyl group (e.g., does not includes any hydroxymethyl groups) than a polyribonucleotide in a composition disclosed herein. In some embodiments, a comparable polynucleotide comprises fewer (e.g., does not include) N4-acetylcytidine and/or fewer (e.g., does not include) 5-hydroxymethyluridine compared to a polyribonucleotide in a composition disclosed herein. In some embodiments, cell viability is a measure of a length of time one or more cells of a cell, tissue or subject live. In some embodiments, cell viability is a measure of a number of cells of a cell, tissue or subject alive at one or more time points.

In some embodiments, a polyribonucleotide disclosed herein is or comprises an RNA oligo.

In some embodiments, a polyribonucleotide disclosed herein is or comprises a messenger RNA (mRNA).

In some embodiments, a polyribonucleotide disclosed herein is or comprises a gRNA.

In some embodiments, a polyribonucleotide disclosed herein is or comprises an inhibitory RNA.

In some embodiments, a polyribonucleotide disclosed herein is or comprises an miRNA or siRNA.

In some embodiments, a polyribonucleotide disclosed herein is or comprises an antisense oligonucleotide.

This disclosure provides a composition comprising one or more polyribonucleotides disclosed herein, e.g., a polyribonucleotide comprising one or more modified ribonucleotides disclosed herein. In some embodiments, a modified ribonucleotide comprises a nucleoside comprising an acetyl group, wherein the nucleoside is N4-acetylcytidine. In some embodiments, a modified ribonucleotide comprises a nucleoside comprising a hydroxymethyl group, wherein the nucleoside is 5-hydroxymethyluridine.

In some embodiments, a composition is a pharmaceutical composition. In some embodiments, a pharmaceutical composition is or comprises an immunogenic composition. In some embodiments, a pharmaceutical composition is or comprises an antibody therapy. In some embodiments, a pharmaceutical composition is or comprises an immune-modulation therapy. In some embodiments, a pharmaceutical composition is or comprises a vaccine. In some embodiments, a pharmaceutical composition is or comprises a gene therapy. In some embodiments, a pharmaceutical composition is or comprises a chemotherapy. In some embodiments, a pharmaceutical composition is or comprises a protein replacement therapy. In some embodiments, a pharmaceutical composition is or comprises an immunotherapy. In some embodiments, a pharmaceutical composition is or comprises a cell engineering therapy.

In some embodiments, a composition comprises double stranded RNA.

Also provided herein is a method comprising, administering one or more polyribonucleotides disclosed herein or a composition comprising the same to a cell, tissue or subject.

In some embodiments, a method further comprises determining cell viability of a cell, tissue or subject. In some embodiments, cell viability is a measure of a length of time one or more cells of a cell, tissue or subject live. In some embodiments, cell viability is a measure of a number of cells of a cell, tissue or subject alive at one or more time points.

In some embodiments, a cell, tissue or subject to which a polyribonucleotide or a composition comprising the same has been administered exhibits improved cell viability as compared to a reference cell viability. In some embodiments, a reference cell viability is a cell viability of a cell, tissue or subject that has been administered a comparable polyribonucleotide or a composition comprising the same that includes: (i) fewer acetyl groups on a nucleobase (e.g., does not include any acetyl groups on a nucleobase) and/or (ii) fewer hydroxymethyl group (e.g., does not includes any hydroxymethyl groups) than a polyribonucleotide in a composition disclosed herein. In some embodiments, a comparable polynucleotide comprises fewer (e.g., does not include) N4-acetylcytidine and/or fewer (e.g., does not include) 5-hydroxymethyluridine compared to a polyribonucleotide in a composition disclosed herein.

In some embodiments, a cell, tissue or subject to which a polyribonucleotide or a composition comprising the same has been administered exhibits a reduced immune response to a polyribonucleotide. In some embodiments, a method disclosed herein further comprises determining an immune system response of a cell, tissue or subject to which a polyribonucleotide or a composition comprising the same has been administered.

In some embodiments, an immune response comprises an innate immune system response comprising innate immune system induced toxicity. In some embodiments, determining an innate immune system response comprises determining a level of NF-κB, IRF, and/or other inflammatory cytokines in a cell, tissue or subject. In some embodiments, determining an innate immune system response comprises determining a level of uncapped RNA detection by a molecular sensor, e.g., RIG-I.

In some embodiments, a cell, tissue or subject to which a polyribonucleotide or a composition comprising the same has been administered exhibits increased expression of a payload. In some embodiments, a method disclosed herein further comprises determining expression of a payload in a cell, tissue or subject to which a polyribonucleotide or a composition comprising the same has been administered. In some embodiments, a payload is or comprises a polypeptide encoded by the polyribonucleotide comprising one or more modified ribonucleotides. In some embodiments, a payload is or comprises a polyribonucleotide situated in the polyribonucleotide comprising one or more modified ribonucleotides. In some embodiments, determining expression of a payload comprises determining expression of an RNA, or a polypeptide, or both. In some embodiments, increase in expression of a payload is about 1.2-fold, about 1.5-fold, about 2-fold, about 4-fold, about 5-fold, about 10-fold or about 20-fold compared to a reference.

In some embodiments, a cell, tissue or subject to which a polyribonucleotide or a composition comprising the same has been administered exhibits a reduced innate immune system response as compared to a reference. In some embodiments, a reference is an innate immune system response of a cell, tissue or subject that has been administered a comparable polyribonucleotide or a composition comprising the same that includes: (i) fewer acetyl groups on a nucleobase (e.g., does not include any acetyl groups on a nucleobase) and/or (ii) fewer hydroxymethyl group (e.g., does not includes any hydroxymethyl groups) than a polyribonucleotide in a composition disclosed herein. In some embodiments, a comparable polynucleotide comprises fewer (e.g., does not include) N4-acetylcytidine and/or fewer (e.g., does not include) 5-hydroxymethyluridine compared to a polyribonucleotide in a composition disclosed herein. In some embodiments, a method disclosed herein further comprises determining efficacy of a polyribonucleotide or a composition comprising the same in a cell, tissue or subject to which a polyribonucleotide or a composition comprising the same has been administered. In some embodiments, determining efficacy comprises determining an antibody response or cellular response in a cell, tissue or subject.

In some embodiments, a cell, tissue or subject to which a polyribonucleotide or a composition comprising the same has been administered exhibits an increased antibody response or cellular response as compared to a reference. In some embodiments, a reference is an antibody response or cellular response of a cell, tissue or subject that has been administered a comparable polyribonucleotide or a composition comprising the same that includes: (i) fewer acetyl groups on a nucleobase (e.g., does not include any acetyl groups on a nucleobase) and/or (ii) fewer hydroxymethyl group (e.g., does not include any hydroxymethyl groups) than a polyribonucleotide in a composition disclosed herein. In some embodiments, a comparable polynucleotide comprises fewer (e.g., does not include) N4-acetylcytidine and/or fewer (e.g., does not include) 5-hydroxymethyluridine compared to a polyribonucleotide in a composition disclosed herein.

In some embodiments, a method comprises administering a polyribonucleotide or a composition comprising the same to a cell, tissue or subject at least two times. In some embodiments, a method comprises administering a polyribonucleotide or a composition comprising the same to a cell, tissue or subject at least 2 times, at least 3 times, at least 4 times, at least 5 times, at least 6 times, at least 7 times, at least 8 times, at least 9 times or at least 10 times. In some embodiments, a method comprises administering a polyribonucleotide or a composition comprising the same to a cell, tissue or subject at least 2 times. In some embodiments, a method comprises administering a polyribonucleotide or a composition comprising the same to a cell, tissue or subject at least 3 times. In some embodiments, a method comprises administering a polyribonucleotide or a composition comprising the same to a cell, tissue or subject at least 4 times. In some embodiments, a method comprises administering a polyribonucleotide or a composition comprising the same to a cell, tissue or subject at least 5 times. In some embodiments, a method comprises administering a polyribonucleotide or a composition comprising the same to a cell, tissue or subject at least 6 times. In some embodiments, a method comprises administering a polyribonucleotide or a composition comprising the same to a cell, tissue or subject at least 7 times. In some embodiments, a method comprises administering a polyribonucleotide or a composition comprising the same to a cell, tissue or subject at least 8 times. In some embodiments, a method comprises administering a polyribonucleotide or a composition comprising the same to a cell, tissue or subject at least 9 times. In some embodiments, a method comprises administering a polyribonucleotide or a composition comprising the same to a cell, tissue or subject at least 10 times.

In some embodiments, at least two administrations of a polyribonucleotide or a composition comprising the same to a cell, tissue or subject does not result in reduced efficacy of a polyribonucleotide or a composition comprising the same compared to administration of one dose of a polyribonucleotide or a composition comprising the same.

In some embodiments, a method comprises administering a polyribonucleotide or a composition comprising the same to a cell, tissue or subject at a higher dose compared to an appropriate reference comparator. In some embodiments, a reference comparator comprises a comparable polyribonucleotide that includes: (i) fewer acetyl groups on a nucleobase (e.g., does not include any acetyl groups on a nucleobase) and/or (ii) fewer hydroxymethyl group (e.g., does not includes any hydroxymethyl groups) than a polyribonucleotide in a composition disclosed herein. In some embodiments, a comparable polynucleotide comprises fewer (e.g., does not include) N4-acetylcytidine and/or fewer (e.g., does not include) 5-hydroxymethyluridine compared to a polyribonucleotide in a composition disclosed herein. In some embodiments of any of the methods disclosed herein, a cell is a mammalian cell, a tissue is a mammalian tissue, or a subject is a mammal. In some embodiments, a mammal is a human.

In some embodiments, a method is a method to stimulate an immune response.

In some embodiments, a method is a vaccination method.

In some embodiments, a method is an antibody therapy method.

In some embodiments, a method is an immune-modulation therapy method.

In some embodiments, a method is a gene therapy method.

In some embodiments, a method comprises delivery of one or more components of a gene therapy such as a gRNA.

In some embodiments, a method is a cell therapy engineering method.

In some embodiments, a method is an immunotherapy method. In some embodiments, an immunotherapy method comprises delivery of an immune-modulation therapy and/or an immune checkpoint therapy.

In some embodiments, a method is a protein replacement therapy method. In some embodiments, a protein replacement therapy method comprises delivery of an enzyme replacement therapy.

In some embodiments, a method is a chemotherapeutic method.

Also provided herein is a method of vaccination comprising administering one or more polyribonucleotides disclosed herein or a composition comprising the same to a cell, tissue or subject.

Disclosed herein is a method of immunotherapy comprising administering one or more polyribonucleotides disclosed herein or a composition comprising the same to a cell, tissue or subject.

Provided herein is a method of providing an antibody therapy comprising administering one or more polyribonucleotides disclosed herein or a composition comprising the same to a cell, tissue or subject. In some embodiments, an antibody therapy comprises an antibody, a fragment, a variant, or a fusion thereof. In some embodiments, an antibody therapy comprises a fragment comprising an antigen-recognition domain (e.g., an scFv, a Fab or other fragments), or an intact antibody, or a polypeptide comprising antigen binding specificity fused to an Fc. In some embodiments, an antibody therapy comprises a bispecific, a multispecific, a heterodimer, a Crossmab, a DVD-Ig, a 2 in 1 IgG, an IgG-sc-FV, an scFv-scFv, a BiTE, a DART, a diabody, a Fab-scFv fusion, a Fab-Fab fusion, a tandem antibody, or any other art recognized antibody formats.

Provided herein is a method of providing an immune-modulation therapy comprising administering one or more polyribonucleotides disclosed herein or a composition comprising the same to a cell, tissue or subject. In some embodiments, an immune-modulation therapy comprises: a cytokine or a variant or fragment thereof, a chemokine or a variant or fragment thereof, a T-cell modulator, an NK cell modulator, a B cell modulator, a myeloid cell modulator, a modulator of any other immune cell, or a combination thereof. In some embodiments, an immune-modulation therapy comprises a chimeric antigen receptor (CAR) therapy. In some embodiments, an immune-modulation therapy, comprises an engineered T cell receptor (TCR) therapy.

Provided herein is a method of gene therapy comprising administering one or more polyribonucleotides disclosed herein or a composition comprising the same to a cell, tissue or subject.

This disclosed provides, a method of protein replacement therapy, comprising administering one or more polyribonucleotides disclosed herein or a composition comprising the same to a cell, tissue or subject.

Also disclosed herein is a method of cell engineering therapy, comprising administering one or more polyribonucleotides disclosed herein or a composition comprising the same to a cell, tissue or subject.

This disclosed provides, a method of obtaining a lower level of immunogenicity in a subject who has received a polyribonucleotide comprising a modified ribonucleotide, or a composition comprising the same, as compared with a subject who has received a comparable unmodified polyribonucleotide. In some embodiments, a method comprises administering a polyribonucleotide comprising a modified ribonucleotide or a composition comprising the same to a subject.

In some embodiments of any of the methods, uses or compositions disclosed herein, a polyribonucleotide comprising a modified ribonucleotide does not comprise a 5' cap, e.g., a 5'-5' triphosphate linked guanosine. In some embodiments, a polyribonucleotide comprising a modified ribonucleotide comprises a 5' phosphate and/or a hydroxyl group at the 5' terminus of the polyribonucleotide.

In some embodiments of any of the methods, uses or compositions disclosed herein, a polyribonucleotide comprising a modified ribonucleotide comprises a 5' cap, e.g., a 5'-5' triphosphate linked guanosine.

In some embodiments, a subject who has received a polyribonucleotide comprising a modified ribonucleotide or a composition comprising the same, and a subject who has received a comparable unmodified polyribonucleotide are the same subject.

In some embodiments, a subject who has received a polyribonucleotide comprising a modified ribonucleotide or a composition comprising the same, and a subject who has received a comparable unmodified polyribonucleotide are different subjects.

Provided herein is a method of manufacturing an RNA composition comprising introducing at least one modified ribonucleotide disclosed herein into a polyribonucleotide. In some embodiments, a method does not comprise removing double-stranded RNA from the RNA composition.

Disclosed herein is a cell comprising a polyribonucleotide disclosed herein or a composition comprising the same.

Also disclosed herein is use of a modified ribonucleotide disclosed herein in the production of a polyribonucleotide.

This disclosure provides use of a polyribonucleotide disclosed herein or a composition comprising the same in the preparation of a medicament for stimulating an immune response.

Provided herein is use of a polyribonucleotide disclosed herein or a composition comprising the same in the preparation of a medicament for use as a vaccine.

This disclosure provides use of a polyribonucleotide disclosed herein or a composition comprising the same in the preparation of a medicament for use as an immunotherapy.

Provided herein is use of a polyribonucleotide disclosed herein or a composition comprising the same in the preparation of a medicament for use as an antibody therapy.

Provided herein is use of a polyribonucleotide disclosed herein or a composition comprising the same in the preparation of a medicament for use as an immune-modulation therapy.

Provided herein is use of a polyribonucleotide disclosed herein or a composition comprising the same in the preparation of a medicament for use as a gene therapy.

This disclosure provides use of a polyribonucleotide disclosed herein or a composition comprising the same in the preparation of a medicament for use as a protein replacement therapy.

Provided herein is use of a polyribonucleotide disclosed herein or a composition comprising the same in the preparation of a medicament for use as a cell engineering therapy.

This disclosure provides use of a polyribonucleotide disclosed herein or a composition comprising the same in the preparation of a medicament for use as a chemotherapy.

This disclosure provides use of a polyribonucleotide disclosed herein or a composition comprising the same in the preparation of a medicament for stimulating an immune response.

Provided herein is a composition comprising a polyribonucleotide disclosed herein for use as a vaccine.

This disclosure provides a composition comprising a polyribonucleotide disclosed herein for use as an immunotherapy.

Provided herein is a composition comprising a polyribonucleotide disclosed herein for use as an antibody therapy.

Provided herein is a composition comprising a polyribonucleotide disclosed herein for use as an immune-modulation therapy.

Provided herein is a composition comprising a polyribonucleotide disclosed herein for use as a gene therapy.

This disclosure a composition comprising a polyribonucleotide disclosed herein for use as a protein replacement therapy.

Provided herein is a composition comprising a polyribonucleotide disclosed herein for use as a cell engineering therapy.

This disclosure provides a composition comprising a polyribonucleotide disclosed herein for use as a chemotherapy.

In some embodiments of any of the uses or methods provided herein, a polyribonucleotide or a composition comprising the same is administered to a cell, tissue or subject.

In some embodiments of any of the uses or methods provided herein a cell is a mammalian cell, a tissue is a mammalian tissue, or a subject is a mammal. In some embodiments, a mammal is a human.

BRIEF DESCRIPTION OF THE DRAWINGS

FIG. 7 shows the differences in serum cytokines in BALB/c mice administered the various RNAs.

CERTAIN DEFINITIONS

Figure 1:
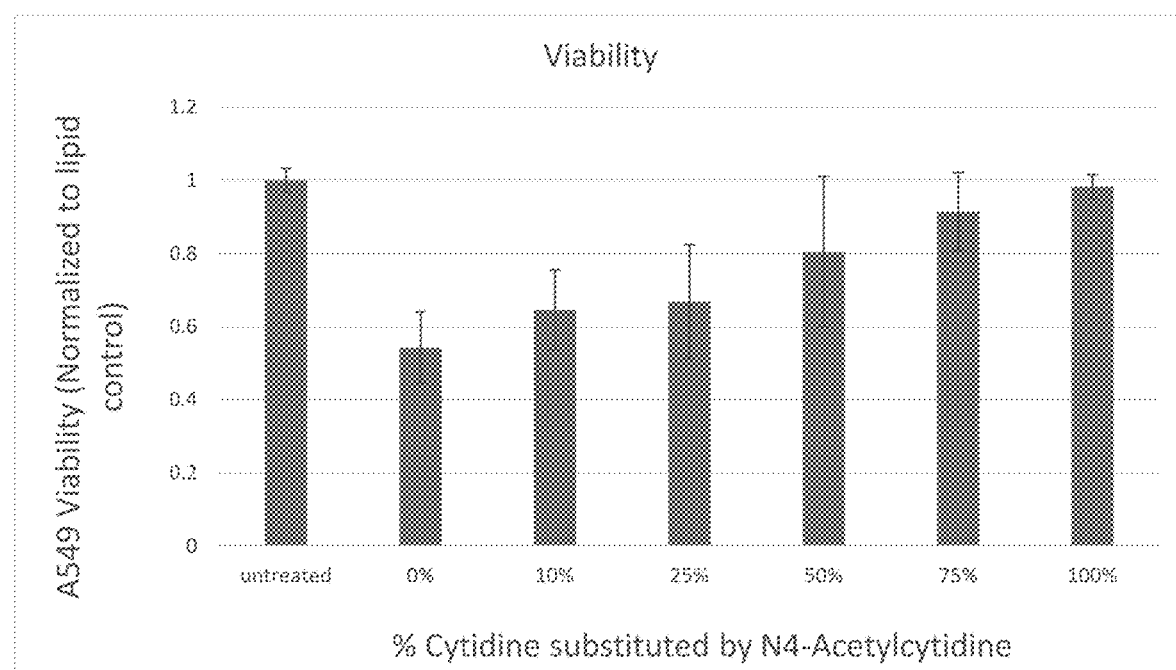
FIG. 1 is a graph showing viability of A549 cells following transfection with RNA synthesized using indicated percentage of N4-Acetylcytidine instead of unmodified (e.g., natural) cytidine.

About or approximately: As used herein, the terms "about" and "approximately," when used herein in reference to a value, refers to a value that is similar, in context to the referenced value. In general, those skilled in the art, familiar with the context, will appreciate the relevant degree of variance encompassed by "about" or "approximately" in that context. For example, in some embodiments, the term "about" or "approximately" may encompass a range of values that within 25%, 20%, 19%, 18%, 17%, 16%, 15%, 14%, 13%, 12%, 11%, 10%, 9%, 8%, 7%, 6%, 5%, 4%, 3%, 2%, 1%, or less of the referred value.

Antibody: As used herein, the term "antibody" refers to a polypeptide that includes canonical immunoglobulin sequence elements sufficient to confer specific binding to a particular target antigen. As is known in the art, intact antibodies as produced in nature are approximately 150 kD tetrameric agents comprised of two identical heavy chain polypeptides (about 50 kD each) and two identical light chain polypeptides (about 25 kD each) that associate with each other into what is commonly referred to as a "Y-shaped" structure. Each heavy chain is comprised of at least four domains (each about 110 amino acids long)—an amino-terminal variable (VH) domain (located at the tips of the Y structure), followed by three constant domains: CH1, CH2, and the carboxy-terminal CH3 (located at the base of the Y's stem). A short region, known as the "switch", connects the heavy chain variable and constant regions. The "hinge" connects CH2 and CH3 domains to the rest of the antibody. Two disulfide bonds in this hinge region connect the two heavy chain polypeptides to one another in an intact antibody. Each light chain is comprised of two domains—an amino-terminal variable (VL) domain, followed by a carboxy-terminal constant (CL) domain, separated from one another by another "switch". Intact antibody tetramers are comprised of two heavy chain-light chain dimers in which the heavy and light chains are linked to one another by a single disulfide bond; two other disulfide bonds connect the heavy chain hinge regions to one another, so that the dimers are connected to one another and the tetramer is formed. Naturally-produced antibodies are also glycosylated, typically on the CH2 domain. Each domain in a natural antibody has a structure characterized by an "immunoglobulin fold" formed from two beta sheets (e.g., 3-, 4-, or 5-stranded sheets) packed against each other in a compressed antiparallel beta barrel. Each variable domain contains three hypervariable loops known as "complementarity determining regions" (CDR1, CDR2, and CDR3) and four somewhat invariant "framework" regions (FR1, FR2, FR3, and FR4). When natural antibodies fold, the FR regions form the beta sheets that provide the structural framework for the domains, and the CDR loop regions from both the heavy and light chains are brought together in three-dimensional space so that they create a single hypervariable antigen binding site located at the tip of the Y structure. The Fc region of naturally-occurring antibodies binds to elements of the complement system, and also to receptors on effector cells, including for example effector cells that mediate cytotoxicity. As is known in the art, affinity and/or other binding attributes of Fc regions for Fc receptors can be modulated through glycosylation or other modification. In some embodiments, antibodies produced and/or utilized in accordance with the present disclosure include glycosylated Fc domains, including Fc domains with modified or engineered such glycosylation. In some embodiments, antibodies produced and/or utilized in accordance with the present disclosure include one or more modifications on an Fc domain, e.g., an effector null mutation, e.g., a LALA, LAGA, FEGG, AAGG, or AAGA mutation. For purposes of the present disclosure, in certain embodiments, any polypeptide or complex of polypeptides that includes sufficient immunoglobulin domain sequences as found in natural antibodies can be referred to and/or used as an "antibody", whether such polypeptide is naturally produced (e.g., generated by an organism reacting to an antigen), or produced by recombinant engineering, chemical synthesis, or other artificial system or methodology. In some embodiments, an antibody is polyclonal; in some embodiments, an antibody is monoclonal. In some embodiments, an antibody has constant region sequences that are characteristic of dog, cat, mouse, rabbit, primate, or human antibodies. In some embodiments, antibody sequence elements are human, humanized, primatized, chimeric, etc, as is known in the art. Moreover, the term "antibody" as used herein, can refer in appropriate embodiments (unless otherwise stated or clear from context) to any of the art-known or developed constructs or formats for utilizing antibody structural and functional features in alternative presentation. For example, in some embodiments, an antibody utilized in accordance with the present invention is in a format selected from, but not limited to, intact IgA, IgG, IgE or IgM antibodies; bi- or multi-specific antibodies (e.g., Zybodies®, etc); antibody fragments such as Fab fragments, Fab' fragments, F(ab')2 fragments, Fd' fragments, Fd fragments, and isolated CDRs or sets thereof; single chain Fvs; polypeptide-Fc fusions; single domain antibodies, alternative scaffolds or antibody mimetics (e.g., anticalins, FN3 monobodies, DARPins, Affibodies, Affilins, Affimers, Affitins, Alphabodies, Avimers, Fynomers, Im7, VLR, VNAR, Trimab, CrossMab, Trident); nanobodies, binanobodies, F(ab')2, Fab', di-sdFv, single domain antibodies, trifunctional antibodies, diabodies, and minibodies. etc. In some embodiments, relevant formats may be or include: Adnectins®; Affibodies®; Affilins®; Anticalins®; Avimers®; BiTE®s; cameloid antibodies; Centyrins®; ankyrin repeat proteins or DARPINs®; dual-affinity re-targeting (DART) agents; Fynomers®; shark single domain antibodies such as IgNAR; immune mobilixing monoclonal T cell receptors against cancer (ImmTACs); KALBITOR®s; MicroProteins; Nanobodies® minibodies; masked antibodies (e.g., Probodies®); Small Modular ImmunoPharmaceuticals ("SMIPs™"); single chain or Tandem diabodies (TandAb®); TCR-like antibodies; Trans-bodies®; TrimerX®; VHHs. In some embodiments, an antibody may lack a covalent modification (e.g., attachment of a glycan) that it would have if produced naturally. In some embodiments, an antibody may contain a covalent modification (e.g., attachment of a glycan, a payload [e.g., a detectable moiety, a therapeutic moiety, a catalytic moiety, etc], or other pendant group [e.g., poly-ethylene glycol, etc.]).

Administering: As used herein, the term "administering" or "administration" typically refers to administration of a composition to a subject to achieve delivery of an agent that is, or is included in, the composition. Those of ordinary skill in the art will be aware of a variety of routes that may, in appropriate circumstances, be utilized for administration to a subject, for example a human. For example, in some embodiments, administration may be ocular, oral, parenteral, topical, etc. In some particular embodiments, administration may be bronchial (e.g., by bronchial instillation), buccal, dermal (which may be or comprise, for example, one or more of topical to the dermis, intradermal, interdermal, transdermal, etc.), enteral, intra-arterial, intradermal, intragastric, intramedullary, intramuscular, intranasal, intraperitoneal, intrathecal, intravenous, intraventricular, within a specific organ (e.g., intrahepatic), mucosal, nasal, oral, rectal, subcutaneous, sublingual, topical, tracheal (e.g., by intratracheal instillation), vaginal, vitreal, etc. In some embodiments, administration may involve only a single dose. In some embodiments, administration may involve application of a fixed number of doses. In some embodiments, administration may involve dosing that is intermittent (e.g., a plurality of doses separated in time) and/or periodic (e.g., individual doses separated by a common period of time) dosing. In some embodiments, administration may involve continuous dosing (e.g., perfusion) for at least a selected period of time.

Antigen: The term "antigen", as used herein, refers to an agent that elicits an immune response; and/or (ii) an agent that binds to a T cell receptor (e.g., when presented by an WIC molecule) or to an antibody. In some embodiments, an antigen elicits a humoral response (e.g., including production of antigen-specific antibodies); in some embodiments, an antigen elicits a cellular response (e.g., involving T-cells whose receptors specifically interact with the antigen). In some embodiments, an antigen comprises at least one epitope of a target protein. In some embodiments, an epitope may be a linear epitope. In some embodiments, an epitope may be a conformational epitope. In some embodiments, an antigen binds to an antibody and may or may not induce a particular physiological response in an organism. In general, an antigen may be or include any chemical entity such as, for example, a small molecule, a nucleic acid, a polypeptide, a carbohydrate, a lipid, a polymer (in some embodiments other than a biologic polymer [e.g., other than a nucleic acid or amino acid polymer] etc. In some embodiments, an antigen is or comprises a polypeptide. In some embodiments, an antigen is or comprises a glycan. Those of ordinary skill in the art will appreciate that, in general, an antigen may be provided in isolated or pure form, or alternatively may be provided in crude form (e.g., together with other materials, for example in an extract such as a cellular extract or other relatively crude preparation of an antigen-containing source). In some embodiments, antigens utilized in accordance with the present invention are provided in a crude form. In some embodiments, an antigen is a recombinant antigen.

Delivery/contacting: As used interchangeably herein, the term "delivery," "delivering," or "contacting" refers to introduction of a fusion polynucleotide (e.g., as described herein) or a fusion polypeptide (e.g., as described herein) into a target cell. A target cell can be cultured in vitro or ex vivo or be present in a subject (in vivo). Methods of introducing a fusion polynucleotide (e.g., as described herein) or a fusion polypeptide (e.g., as described herein) into a target cell can vary with in vitro, ex vivo, or in vivo applications. In some embodiments, a fusion polynucleotide (e.g., as described herein) or a fusion polypeptide (e.g., as described herein) can be introduced into a target cell in a cell culture by in vitro transfection. In some embodiments, a fusion polynucleotide (e.g., as described herein) or a fusion polypeptide (e.g., as described herein) can be introduced into a target cell via delivery vehicles (e.g., nanoparticles, liposomes, and/or complexation with a cell-penetrating agent). In some embodiments, a fusion polynucleotide (e.g., as described herein) or a fusion polypeptide (e.g., as described herein) can be introduced into a target cell in a subject by administering a fusion polynucleotide (e.g., as described herein) or a fusion polypeptide (e.g., as described herein) to a subject.

Functional: As used herein, the term "functional" is used to refer to a form or fragment of an entity that exhibits a particular property and/or activity.

Fragment: A "fragment" of a material or entity as described herein has a structure that includes a discrete portion of the whole, but lacks one or more moieties found in the whole. In some embodiments, a fragment consists of such a discrete portion. In some embodiments, a fragment consists of or comprises a characteristic structural element or moiety found in the whole. In some embodiments, a fragment comprises a polynucleotide fragment. In some embodiments, a fragment comprises a polypeptide fragment. In some embodiments, a polynucleotide fragment or a polypeptide fragment comprises or consists of at least 3, 4, 5, 6, 7, 8, 9, 10, 11, 12, 13, 14, 15, 16, 17, 18, 19, 20, 25, 30, 35, 40, 45, 50, 55, 60, 65, 70, 75, 80, 85, 90, 95, 100, 110, 120, 130, 140, 150, 160, 170, 180, 190, 200, 210, 220, 230, 240, 250, 275, 300, 325, 350, 375, 400, 425, 450, 475, 500 or more monomeric units (e.g., residues) as found in the whole polynucleotide or whole polypeptide. In some embodiments, a polynucleotide fragment or a polypeptide fragment comprises or consists of at least about 5%, 10%, 15%, 20%, 25%, 30%, 25%, 40%, 45%, 50%, 55%, 60%, 65%, 70%, 75%, 80%, 85%, 90%, 95%, 96%, 97%, 98%, 99% or more of the monomeric units (e.g., residues) found in the whole polynucleotide or whole polypeptide. The whole polypeptide or whole polynucleotide may in some embodiments be referred to as the "parent" of the polynucleotide fragment or polypeptide fragment.

Nucleic acid/Oligonucleotide/Polynucleotide: As used herein, the terms "nucleic acid" and "polynucleotide" and "oligonucleotide" are used interchangeably, and refer to a polymer of 3 nucleotides or more. In some embodiments, a nucleic acid comprises DNA. In some embodiments, a nucleic acid comprises RNA. In some embodiments, a nucleic acid comprises messenger RNA (mRNA). In some embodiments, a nucleic acid is single stranded. In some embodiments, a nucleic acid is double stranded. In some embodiments, a nucleic acid comprises both single and double stranded portions. In some embodiments, a nucleic acid comprises a backbone that comprises one or more phosphodiester linkages. In some embodiments, a nucleic acid comprises a backbone that comprises both phosphodiester and non-phosphodiester linkages. For example, in some embodiments, a nucleic acid may comprise a backbone that comprises one or more phosphorothioate or 5'-N-phosphoramidite linkages and/or one or more peptide bonds, e.g., as in a "peptide nucleic acid". In some embodiments, a nucleic acid comprises one or more, or all, natural residues (e.g., adenine, cytosine, deoxyadenosine, deoxycytidine, deoxyguanosine, deoxythymidine, guanine, thymine, uracil). In some embodiments, a nucleic acid comprises on or more, or all, non-natural residues. In some embodiments, a non-natural residue comprises a nucleoside analog (e.g., 2-aminoadenosine, 2-thiothymidine, inosine, pyrrolo-pyrimidine, 3-methyl adenosine, 5-methylcytidine, C-5 propynyl-cytidine, C-5 propynyl-uridine, 2-aminoadenosine, C5-bromouridine, C5-fluorouridine, C5-iodouridine, C5-propynyl-uridine, C5-propynyl-cytidine, C5-methylcytidine, 2-aminoadenosine, 7-deazaadenosine, 7-deazaguanosine, 8-oxoadenosine, 8-oxoguanosine, 6-O-methylguanine, 2-thiocytidine, methylated bases, intercalated bases, and combinations thereof). In some embodiments, a non-natural residue comprises one or more modified sugars (e.g., 2'-fluororibose, ribose, 2'-deoxyribose, arabinose, and hexose) as compared to those in natural residues. In some embodiments, a nucleic acid has a nucleotide sequence that encodes a functional gene product such as an RNA or polypeptide. In some embodiments, a nucleic acid has a nucleotide sequence that comprises one or more introns. In some embodiments, a nucleic acid may be prepared by isolation from a natural source, enzymatic synthesis (e.g., by polymerization based on a complementary template, e.g., in vivo or in vitro, reproduction in a recombinant cell or system, or chemical synthesis. In some embodiments, a nucleic acid is at least 3, 4, 5, 6, 7, 8, 9, 10, 15, 20, 25, 30, 35, 40, 45, 50, 55, 60, 65, 70, 75, 80, 85, 90, 95, 100, 110, 120, 130, 140, 150, 160, 170, 180, 190, 20, 225, 250, 275, 300, 325, 350, 375, 400, 425, 450, 475, 500, 600, 700, 800, 900, 1000, 1500, 2000, 2500, 3000, 3500, 4000, 4500, 5000, 5500, 6000, 6500, 7000, 7500, 8000, 8500, 9000, 9500, 10,000, 10,500, 11,000, 11,500, 12,000, 12,500, 13,000, 13,500, 14,000, 14,500, 15,000, 15,500, 16,000, 16,500, 17,000, 17,500, 18,000, 18,500, 19,000, 19,500, or 20,000 or more residues or nucleotides long. When a number of nucleotides is used as an indication of size, e.g., of a fusion polynucleotide, a certain number of nucleotides refers to the number of nucleotides on a single strand, e.g., of a fusion polynucleotide.

Polypeptide: The term "polypeptide", as used herein, generally has its art-recognized meaning of a polymer of at least three amino acids or more. Those of ordinary skill in the art will appreciate that the term "polypeptide" is intended to be sufficiently general as to encompass not only polypeptides having a complete sequence recited herein, but also to encompass polypeptides that represent functional, biologically active, or characteristic fragments, portions or domains (e.g., fragments, portions, or domains retaining at least one activity) of such complete polypeptides. Polypeptides may contain L-amino acids, D-amino acids, or both and may contain any of a variety of amino acid modifications or analogs known in the art. Useful modifications include, e.g., terminal acetylation, amidation, methylation, etc. In some embodiments, polypeptides may comprise natural amino acids, non-natural amino acids, synthetic amino acids, and combinations thereof.

Polyribonucleotide: As used herein, the term "polyribonucleotide" refers to a polymer of 3 ribonucleotides or more. In some embodiments, a polyribonucleotide is single stranded. In some embodiments, a polyribonucleotide is double stranded. In some embodiments, a polyribonucleotide comprises both single and double stranded portions. In some embodiments, a polyribonucleotide can comprise a backbone structure as described in the definition of "Nucleic acid/Oligonucleotide" above. A polyribonucleotide can be a regulatory RNA (e.g., siRNA, microRNA, etc.), or a messenger RNA (mRNA) oligonucleotide. In some embodiments where a polyribonucleotide is a mRNA oligonucleotide, a polyribonucleotide typically comprises at its 3' end a poly(A) region. In some embodiments where a polyribonucleotide is an mRNA oligonucleotide, a polyribonucleotide typically comprises at its 5' end an art-recognized cap structure, e.g., for recognizing and attachment of an mRNA to a ribosome to initiate translation. In some embodiments, a polyribonucleotide comprises an RNA oligonucleotide. When a number of ribonucleotides is used as an indication of size, e.g., for a polyribonucleotide, a certain number of nucleotides refers to the number of ribonucleotides on a single strand.

Subject: As used herein, the term "subject" refers an organism, typically a mammal (e.g., a human). In some embodiments, a subject is suffering from a disease, disorder or condition. In some embodiments, a subject is susceptible to a disease, disorder, or condition. In some embodiments, a subject displays one or more symptoms or characteristics of a disease, disorder or condition. In some embodiments, a subject does not display any symptom or characteristic of a disease, disorder, or condition. In some embodiments, a subject is someone with one or more features characteristic of susceptibility to or risk of a disease, disorder, or condition. In some embodiments, a subject is a patient. In some embodiments, a subject is an individual to whom diagnosis and/or therapy is and/or has been administered.

Variant: As used herein, the term "variant" refers to an entity that shows significant structural identity with a reference entity but differs structurally from the reference entity in the presence or level of one or more chemical moieties as compared with the reference entity. In many embodiments, a variant also differs functionally from its reference entity. In general, whether a particular entity is properly considered to be a "variant" of a reference entity is based on its degree of structural identity with the reference entity. For example, a variant polypeptide may differ from a reference polypeptide as a result of one or more differences in amino acid sequence and/or one or more differences in chemical moieties (e.g., carbohydrates, lipids, etc.) covalently attached to the polypeptide backbone. Alternatively or additionally, in some embodiments, a variant polypeptide does not share at least one characteristic sequence element with a reference polypeptide. In some embodiments, the reference polypeptide has one or more biological activities. In some embodiments, a variant polypeptide shares one or more of the biological activities of the reference polypeptide. In some embodiments, a variant polypeptide lacks one or more of the biological activities of the reference polypeptide. In some embodiments, a variant polypeptide shows a reduced level of one or more biological activities as compared with the reference polypeptide.

Standard techniques may be used for recombinant DNA, oligonucleotide synthesis, e.g., RNA synthesis, and tissue culture and transformation (e.g., electroporation, lipofection). Enzymatic reactions and purification techniques may be performed according to manufacturer's specifications or as commonly accomplished in the art or as described herein. The foregoing techniques and procedures may be generally performed according to conventional methods well known in the art and as described in various general and more specific references that are cited and discussed throughout the present specification. See e.g., Sambrook et al., Molecular Cloning: A Laboratory Manual (2nd ed., Cold Spring Harbor Laboratory Press, Cold Spring Harbor, N.Y. (1989)), which is incorporated herein by reference for any purpose.

DETAILED DESCRIPTION OF CERTAIN EMBODIMENTS

With the recent introduction of RNA-based vaccines against SARS-CoV-2, the capabilities of a therapeutic platform that has been in development for quite some time has come to the forefront. RNA therapeutics have real potential to be applied to a variety of indications, but their broad application beyond vaccines is still limited by adverse effects caused by undesirable activation of the human body's innate immune response. Over the course of human evolution the human body has developed mechanisms to combat a wide variety of pathogens. Introduction of exogenous RNA into human cells can trigger a number of innate immune sensors that recognize the RNA as non-self. Cytoplasmic sensors such as MDA5, PKR, and OAS can all recognize dsRNA contaminants produced during RNA synthesis or functional secondary structures that are inherent to the RNA transcript itself. RIG-I is an example of a major sensor of uncapped RNA while TLRs 3, 7, and 8 are examples of general sensors of "non-self" RNAs. These sensors can promote an antiviral response that leads to inhibition of protein translation. Coupled with translation inhibition is the common incidence of an excessive inflammatory response, which can manifest as severe side effects in a patient. An effective RNA therapeutic must be able to direct high expression of the protein of interest while being well tolerated by the patient receiving the therapeutic. These objectives can both be achieved by bypassing the body's innate immune sensors.

One technology that has the potential to address this issue is the use of chemically modified nucleotides that dampen excessive innate immune response to RNAs enough such that side effects are tolerable and efficacy is not diminished severely. Accordingly, the present disclosure provides technologies for reducing immunogenicity of RNA therapeutics by providing a polyribonucleotide comprising a modified ribonucleotide. In some embodiments, a modified ribonucleotide comprises a ribonucleotide comprising N4-acetylcytidine and/or a ribonucleotide comprising 5-hydroxymethyluridine. As discussed herein, the immunogenicity reduced is that caused by administration of RNA therapeutics in response to the RNA molecules themselves, which should be contrasted with immunogenicity caused by, e.g., polypeptides encoded by the RNA molecules, which may be desirable as a result of, e.g., an RNA vaccine. Among other disclosed herein is the novel discovery that in vitro transcribed RNAs containing N4-Acetylcytidine in place of unmodified cytidines and/or 5-hydroxymethyluridine in place of unmodified uridines can improve the efficacy of RNA therapeutics due to a strong reduction in undesired innate immune response.

An earlier study found that N4-Acetylcytidine can increase the translation of RNA transcripts that contain it as a result of improved interaction with tRNAs that recognize codons containing cytidine in the wobble position (Arango, et al. (2018) *Cell* 175(7):1872-1886). This study did not address the effect of N4-Acetylcytidine on the immunogenicity of RNA transcripts comprising the same or the therapeutic effect of RNA compositions comprising N4-Acetylcytidine. Indeed Arango et al saw no difference in the phosphorylation of eIF2a, which can be an indirect indicator of innate immune response, between RNAs having N4-Acetylcytidine and those that do not.

The present disclosure is the first to demonstrate the surprising finding that RNAs (e.g., mRNAs) incorporating N4-Acetylcytidine result in significantly improved cell viability and reduced toxicity caused by the RNA in vivo. Among other things, disclosed herein is the finding that the extent of improvement in cell viability is affected by the percentage of cytidine nucleotides substituted by N4-acetylcytidine. In some embodiments, a decrease in polypeptide expression, e.g., reporter protein expression, is observed with a polyribonucleotide in which all cytidines are N4-Acetylcytidine. In some embodiments, a preferred ratio of modified nucleotide to unmodified nucleotide likely depends on the specific codon composition of a nucleotide sequence in question and a therapeutic application in which it is being used.

The present disclosure also recognizes that a polyribonucleotide comprising N4-Acetylcytidine and/or 5-hydroxymethyluridine mediates evasion of an innate immune system, improves viability of cells into which said polyribonucleotide is introduced, and/or increases expression of a payload in cells into which said polyribonucleotide is introduced. In some embodiments, evasion of an innate immune system comprises a reduction in activation of NFkb or an NFkb pathway, IRF or an IRF pathway, and/or other inflammatory cytokines in a cell, tissue or organism into which said polyribonucleotide is introduced. In some embodiments, evasion of an innate immune system comprises a reduction in detection of uncapped RNA in a cell, tissue or organism into which said polyribonucleotide is introduced.

Among other things, disclosed herein is the finding that the extent of innate immune evasion and the magnitude of increase in payload expression is affected by the percentage of cytidine nucleotides substituted with N4-acetylcytidine and/or the percentage of uridine nucleotides substituted with 5-hydroxymethyluridine in a polyribonucleotide. In some embodiments, substitution of a large proportion (e.g., about or more than 75%) of cytidine with N4-acetylcytidine in a polyribonucleotide provides enhanced innate immune evasion (e.g., complete innate immune evasion) and/or increased payload expression. In some embodiments, substitution of a large proportion (e.g., about or more than 75%) of uridine with 5-hydroxymethyluridine in a polyribonucleotide provides enhanced innate immune evasion (e.g., complete innate immune evasion) and/or increased payload expression. In some embodiments, substitution of a large proportion (e.g., about or more than 75%) of cytidine with N4-acetylcytidine in a polyribonucleotide, and substitution of a large proportion (e.g., about or more than 75%) of uridine with 5-hydroxymethyluridine in a polyribonucleotide provides enhanced innate immune evasion (e.g., complete innate immune evasion) and/or increased payload expression.

The insights and findings provided in the present disclosure further allow for the tuning of (e.g., ability to make incremental changes to) payload expression and/or immunogenicity from a polyribonucleotide comprising one or more modified ribonucleotides, e.g., as disclosed herein. For example, based on the desired application of a polyribonucleotide comprising one or more modified ribonucleotides, a particular level of expression of a payload from the polyribonucleotide can be achieved by using one or more modified ribonucleotides as described herein. Additionally, based on the desired application of a polyribonucleotide comprising one or more modified ribonucleotides, a particular level of immunogenicity associated with a polyribonucleotide can be achieved by using one or more modified ribonucleotides as described herein.

Figure 2:
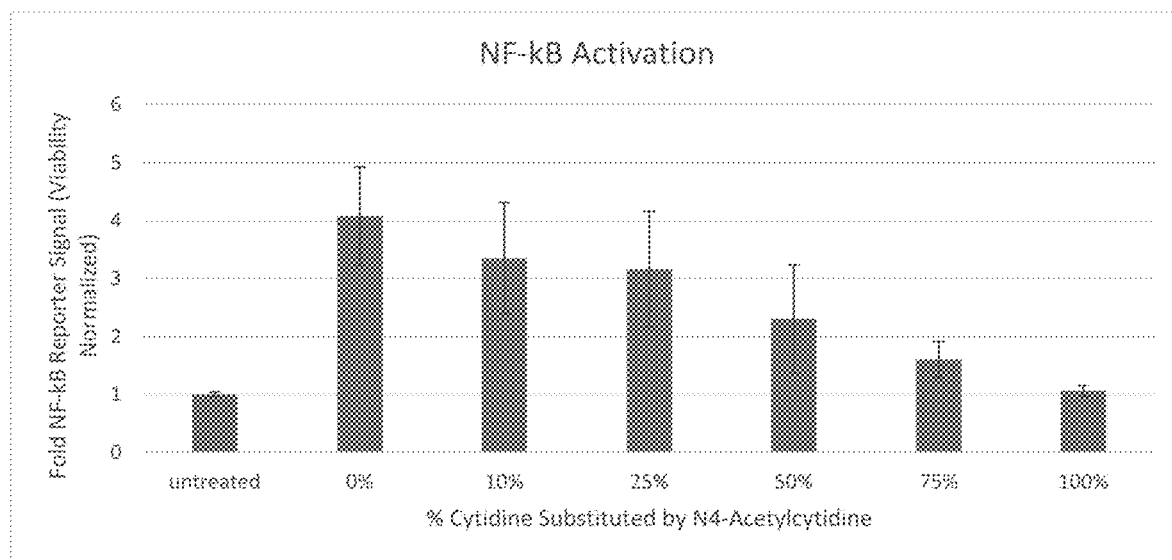
FIG. 2 is a graph depicting NF-Kb reporter activation by RNA synthesized using the indicated percentage of N4-Acetylcytidine instead of unmodified cytidine.
Figure 3:
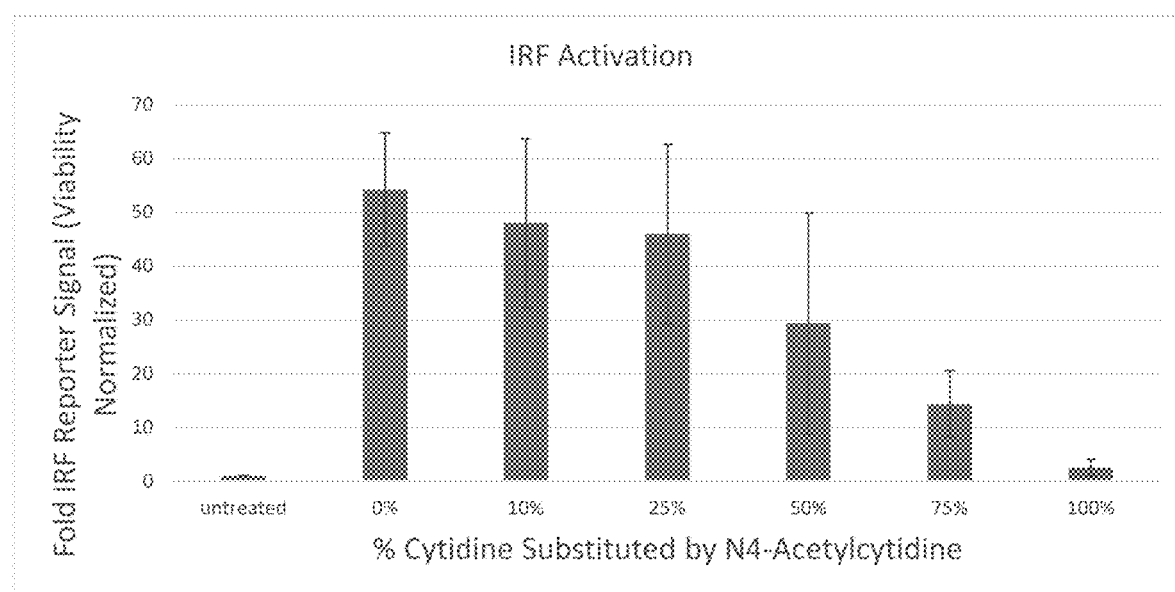
FIG. 3 is a graph showing IRF reporter activation by RNA synthesized using the indicated percentage of N4-Acetylcytidine instead of unmodified cytidine.

The present disclosure also provides the insight that immunogenicity from a polyribonucleotide could be reduced, for example by modifying the percentage of cytidine nucleosides substituted with N4-acetylcytidine in a polyribonucleotide. For example, a polyribonucleotide having no N4-acetylcytidine in place of cytidines can be associated with a particular level of immunogenicity. A polyribonucleotide having, e.g., 25% N4-acetylcytidine in place of cytidines can provide for reduced immunogenicity compared to the level observed from a polyribonucleotide having no N4-acetylcytidine in place of cytidines. FIGS. 2 and 3 herein provide exemplary reduction in immunogenicity with a polyribonucleotide having more than 25% cytidine nucleosides substituted with N4-acetylcytidine. A polyribonucleotide having, e.g., 50% N4-acetylcytidine in place of cytidines can provide for an even greater reduction in immunogenicity compared to the level observed from a polyribonucleotide having no N4-acetylcytidine in place of cytidines.

Figure 16:
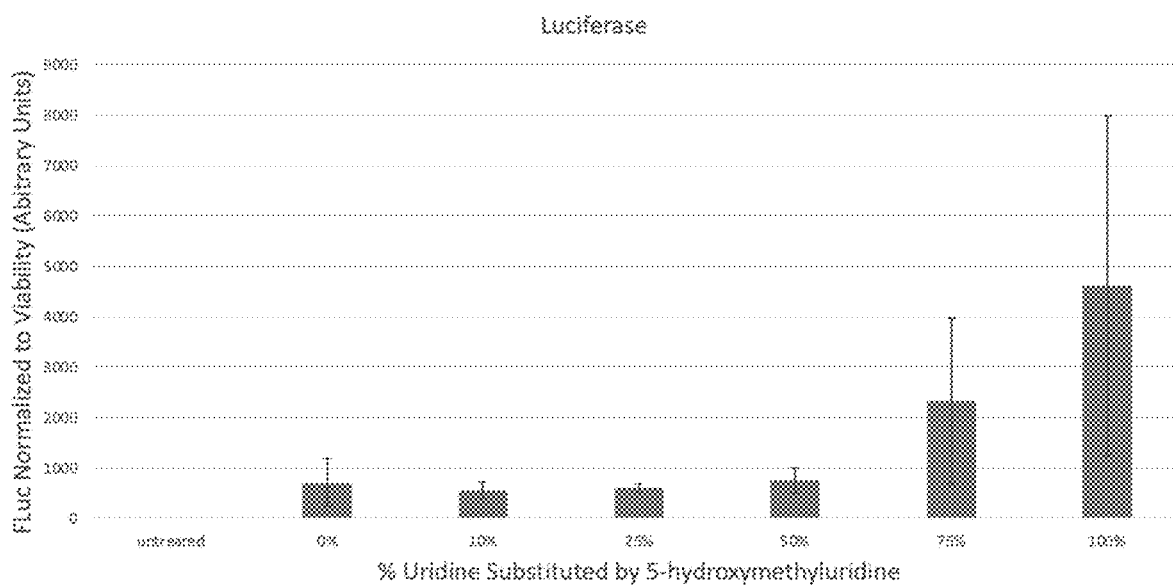
FIG. 16 shows Luciferase gene expression normalized to cell viability by RNA synthesized using indicated percentage 5-hydroxymethyluridine instead of natural uridine.

The present disclosure also provides the insight that expression of a payload could be increased, for example by modifying the percentage of uridine nucleosides substituted with 5-hydroxymethyluridine in a polyribonucleotide. For example, a polyribonucleotide having no 5-hydroxymethyluridine in place of its uridine residues can provide a particular level of payload expression. A polyribonucleotide having, e.g., 25% 5-hydroxymethyluridine in place of its uridines can provide for increased expression compared to the level observed from a polyribonucleotide having no 5-hydroxymethyluridine in place of its uridines. A polyribonucleotide having, e.g., 50% 5-hydroxymethyluridine in place of its uridines can provide for an even greater increase in expression compared to the level observed from a polyribonucleotide having no 5-hydroxymethyluridine in place of its uridines. FIG. 16 herein provides exemplary increase in expression of a payload with a polyribonucleotide having more than 50% uridines substituted with 5-hydroxymethyluridines.

In some embodiments, a payload is or comprises a polypeptide encoded by a polyribonucleotide comprising a modified ribonucleotide.

In some embodiments, a payload is or comprises an RNA situated in a polyribonucleotide comprising a modified ribonucleotide.

In some embodiments, use of a polyribonucleotide comprising N4-Acetylcytidine and/or 5-hydroxymethyluridine allows for improved efficacy of RNA therapeutics comprising the same and/or better tolerability in a subject administered the same.

In some embodiments, a polyribonucleotide comprising N4-acetylcytidine and/or 5-hydroxymethyluridine allows for repeated dosing without a reduction in payload expression and/or therapeutic efficacy.

In some embodiments, a polyribonucleotide comprising N4-acetylcytidine and/or 5-hydroxymethyluridine allows for administration of a high dose of a polyribonucleotide without a reduction in payload expression and/or without an increase in immunogenicity. In some embodiments, a high dose of a polyribonucleotide disclosed herein is in reference to a dose of an RNA therapeutic currently used in patients, e.g., as approved by the FDA or in clinical trials. For example, Damase T R et al., (2021) Front. Bioeng. Biotechnol., https://doi.org/10.3389/fbioe.2021.628137, which is hereby incorporated by reference in its entirety, provides RNA therapeutics that are currently FDA approved or in clinical trials (See Table 1 therein). For the RNA therapeutics discussed in Damase 2021, one with skill in the art would understand that the approved doses for any of the RNA therapeutics can be obtained from the FDA approval package of said drug, or the clinical trials website which can be accessed at: https://clinicaltrials.gov/. For example, the approved dose of Eteplirsen is 30 mg/kg; the approved dose of Patisiran is 0.3 mg/kg for patients weighing less than 100 kg and 30 mg for patients weighing more than or equal to 100 kg; and the approved dose for the COVID-19 vaccine mrna-1273 (Moderna) is 100 micrograms.

In some embodiments, a polyribonucleotide comprising N4-acetylcytidine and/or 5-hydroxymethyluridine allows for administration of a polyribonucleotide (e.g., repeated dosing) about every 1 hour, about every 2 hours, about every 3 hours, about every 4 hours, about every 5 hours, about every 6 hours, about every 8 hours, about every 10 hours, about every 12 hours, about every 24 hours, about every 36 hours, about every 48 hours, or about every 72 hours. In some embodiments, a polyribonucleotide is administered about every 1-72 hours, about every 2-72 hours, about every 3-72 hours, about every 4-72 hours, about every 5-72 hours, about every 6-72 hours, about every 8-72 hours, about every 10-72 hours, about every 12-72 hours, about every 24-72 hours, about every 36-72 hours, about every 48-72 hours, about every 1-48 hours, about every 1-36 hours, about every 1-24 hours, about every 1-12 hours, about every 1-10 hours, about every 1-8 hours, about every 1-6 hours, about every 1-5 hours, about every 1-4 hours, about every 1-3 hours, or about every 1-2 hours.

In some embodiments, a polyribonucleotide comprising N4-acetylcytidine and/or 5-hydroxymethyluridine allows for administration (e.g., dosing) of a polyribonucleotide (e.g., repeated administration) hourly, daily, weekly, monthly, or yearly.

Acetylated Nucleotides

Among other things, provided herein are polyribonucleotides comprising one or more modified ribonucleotides including a nucleoside comprising an acetyl group. In some embodiments, a nucleoside of a modified ribonucleotide is N4-acetylcytidine and the modified ribonucleotide has: a 5' monophosphate, a 5' diphosphate or a 5' triphosphate.

In some embodiments, a nucleoside of a modified ribonucleotide is N4-acetylcytidine and the modified ribonucleotide has a structure of:

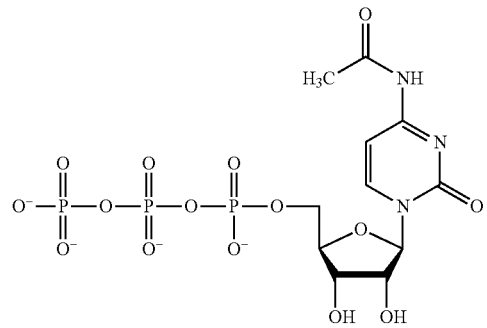

In some embodiments, a polyribonucleotide disclosed herein comprises cytidine residues. In some embodiments, at least 5% of cytidine residues in a polyribonucleotide comprise N4-acetylcytidine. In some embodiments, less than 100% of cytidine residues in a polyribonucleotide comprise N4-acetylcytidine.

In some embodiments, a polyribonucleotide disclosed herein comprises cytidine residues and at least 5% of cytidine residues in a polyribonucleotide comprises N4-acetylcytidine.

In some embodiments, a polyribonucleotide disclosed herein comprises cytidine residues and at least 10% of cytidine residues in a polyribonucleotide comprises N4-acetylcytidine.

In some embodiments, a polyribonucleotide disclosed herein comprises cytidine residues and at least 15% of cytidine residues in a polyribonucleotide comprises N4-acetylcytidine.

In some embodiments, a polyribonucleotide disclosed herein comprises cytidine residues and at least 20% of cytidine residues in a polyribonucleotide comprises N4-acetylcytidine.

In some embodiments, a polyribonucleotide disclosed herein comprises cytidine residues and at least 25% of cytidine residues in a polyribonucleotide comprises N4-acetylcytidine.

In some embodiments, a polyribonucleotide disclosed herein comprises cytidine residues and at least 30% of cytidine residues in a polyribonucleotide comprises N4-acetylcytidine.

In some embodiments, a polyribonucleotide disclosed herein comprises cytidine residues and at least 35% of cytidine residues in a polyribonucleotide comprises N4-acetylcytidine.

In some embodiments, a polyribonucleotide disclosed herein comprises cytidine residues and at least 40% of cytidine residues in a polyribonucleotide comprises N4-acetylcytidine.

In some embodiments, a polyribonucleotide disclosed herein comprises cytidine residues and at least 45% of cytidine residues in a polyribonucleotide comprises N4-acetylcytidine.

In some embodiments, a polyribonucleotide disclosed herein comprises cytidine residues and at least 50% of cytidine residues in a polyribonucleotide comprises N4-acetylcytidine.

In some embodiments, a polyribonucleotide disclosed herein comprises cytidine residues and at least 55% of cytidine residues in a polyribonucleotide comprises N4-acetylcytidine.

In some embodiments, a polyribonucleotide disclosed herein comprises cytidine residues and at least 60% of cytidine residues in a polyribonucleotide comprises N4-acetylcytidine.

In some embodiments, a polyribonucleotide disclosed herein comprises cytidine residues and at least 65% of cytidine residues in a polyribonucleotide comprises N4-acetylcytidine.

In some embodiments, a polyribonucleotide disclosed herein comprises cytidine residues and at least 70% of cytidine residues in a polyribonucleotide comprises N4-acetylcytidine.

In some embodiments, a polyribonucleotide disclosed herein comprises cytidine residues and at least 75% of cytidine residues in a polyribonucleotide comprises N4-acetylcytidine.

In some embodiments, a polyribonucleotide disclosed herein comprises cytidine residues and at least 80% of cytidine residues in a polyribonucleotide comprises N4-acetylcytidine.

In some embodiments, a polyribonucleotide disclosed herein comprises cytidine residues and at least 85% of cytidine residues in a polyribonucleotide comprises N4-acetylcytidine.

In some embodiments, a polyribonucleotide disclosed herein comprises cytidine residues and at least 90% of cytidine residues in a polyribonucleotide comprises N4-acetylcytidine.

In some embodiments, a polyribonucleotide disclosed herein comprises cytidine residues and at least 95% of cytidine residues in a polyribonucleotide comprises N4-acetylcytidine.

In some embodiments, a polyribonucleotide disclosed herein comprises cytidine residues. In some embodiments, about 5% to 99%, about 5% to 95%, about 5% to 90%, about 5% to 85%, about 5% to 80%, about 5% to 75%, about 5% to 70%, about 5% to 65%, about 5% to 60%, about 5% to 55%, about 5% to 50%, about 5% to 45%, about 5% to 40%, about 5% to 35%, about 5% to 30%, about 5% to 25%, about 5% to 20%, about 5% to 15%, about 5% to 10%, about 10% to 99%, about 15% to 99%, about 20% to 99%, about 25% to 99%, about 30% to 99%, about 35% to 99%, about 40% to 99%, about 45% to 99%, about 50% to 99%, about 55% to 99%, about 60% to 99%, about 65% to 99%, about 70% to 99%, about 80% to 99%, about 85% to 99%, about 90% to 99%, or about 95% to 99% of cytidine residues in a polyribonucleotide comprises N4-acetylcytidine.

In some embodiments, a polyribonucleotide disclosed herein comprises cytidine residues and more than about 60% of cytidine residues in a polyribonucleotide comprises N4-acetylcytidine.

In some embodiments, a polyribonucleotide disclosed herein comprises cytidine residues and more than about 65% of cytidine residues in a polyribonucleotide comprises N4-acetylcytidine.

In some embodiments, a polyribonucleotide disclosed herein comprises cytidine residues and more than about 70% of cytidine residues in a polyribonucleotide comprises N4-acetylcytidine.

In some embodiments, a polyribonucleotide disclosed herein comprises cytidine residues and more than about 75% of cytidine residues in a polyribonucleotide comprises N4-acetylcytidine.

In some embodiments, a polyribonucleotide disclosed herein comprises cytidine residues and more than about 80% of cytidine residues in a polyribonucleotide comprises N4-acetylcytidine.

In some embodiments, a polyribonucleotide disclosed herein comprises cytidine residues and more than about 85% of cytidine residues in a polyribonucleotide comprises N4-acetylcytidine.

In some embodiments, a polyribonucleotide disclosed herein comprises cytidine residues and more than about 90% of cytidine residues in a polyribonucleotide comprises N4-acetylcytidine.

In some embodiments, a polyribonucleotide disclosed herein comprises cytidine residues and more than about 95% of cytidine residues in a polyribonucleotide comprises N4-acetylcytidine.

In some embodiments, a polyribonucleotide disclosed herein comprises cytidine residues and more than about 99% of cytidine residues in a polyribonucleotide comprises N4-acetylcytidine.

In some embodiments, a polyribonucleotide disclosed herein comprises cytidine residues and about 5% of cytidine residues in a polyribonucleotide comprises N4-acetylcytidine.

In some embodiments, a polyribonucleotide disclosed herein comprises cytidine residues and about 10% of cytidine residues in a polyribonucleotide comprises N4-acetylcytidine.

In some embodiments, a polyribonucleotide disclosed herein comprises cytidine residues and about 15% of cytidine residues in a polyribonucleotide comprises N4-acetylcytidine.

In some embodiments, a polyribonucleotide disclosed herein comprises cytidine residues and about 20% of cytidine residues in a polyribonucleotide comprises N4-acetylcytidine.

In some embodiments, a polyribonucleotide disclosed herein comprises cytidine residues and about 25% of cytidine residues in a polyribonucleotide comprises N4-acetylcytidine.

In some embodiments, a polyribonucleotide disclosed herein comprises cytidine residues and about 30% of cytidine residues in a polyribonucleotide comprises N4-acetylcytidine.

In some embodiments, a polyribonucleotide disclosed herein comprises cytidine residues and about 35% of cytidine residues in a polyribonucleotide comprises N4-acetylcytidine.

In some embodiments, a polyribonucleotide disclosed herein comprises cytidine residues and about 40% of cytidine residues in a polyribonucleotide comprises N4-acetylcytidine.

In some embodiments, a polyribonucleotide disclosed herein comprises cytidine residues and about 45% of cytidine residues in a polyribonucleotide comprises N4-acetylcytidine.

In some embodiments, a polyribonucleotide disclosed herein comprises cytidine residues and about 50% of cytidine residues in a polyribonucleotide comprises N4-acetylcytidine.

In some embodiments, a polyribonucleotide disclosed herein comprises cytidine residues and about 55% of cytidine residues in a polyribonucleotide comprises N4-acetylcytidine.

In some embodiments, a polyribonucleotide disclosed herein comprises cytidine residues and about 60% of cytidine residues in a polyribonucleotide comprises N4-acetylcytidine.

In some embodiments, a polyribonucleotide disclosed herein comprises cytidine residues and about 65% of cytidine residues in a polyribonucleotide comprises N4-acetylcytidine.

In some embodiments, a polyribonucleotide disclosed herein comprises cytidine residues and about 75% of cytidine residues in a polyribonucleotide comprises N4-acetylcytidine.

In some embodiments, a polyribonucleotide disclosed herein comprises cytidine residues and about 80% of cytidine residues in a polyribonucleotide comprises N4-acetylcytidine.

In some embodiments, a polyribonucleotide disclosed herein comprises cytidine residues and about 85% of cytidine residues in a polyribonucleotide comprises N4-acetylcytidine.

In some embodiments, a polyribonucleotide disclosed herein comprises cytidine residues and about 90% of cytidine residues in a polyribonucleotide comprises N4-acetylcytidine.

In some embodiments, a polyribonucleotide disclosed herein comprises cytidine residues and about 95% of cytidine residues in a polyribonucleotide comprises N4-acetylcytidine.

In some embodiments, a polyribonucleotide disclosed herein comprises cytidine residues and about 99% of cytidine residues in a polyribonucleotide comprises N4-acetylcytidine.

In some embodiments, a polyribonucleotide disclosed herein comprises cytidine residues and 100% of cytidine residues in a polyribonucleotide comprise N4-acetylcytidine.

In some embodiments, a polyribonucleotide disclosed herein (e.g., a polyribonucleotide comprising cytidine residues with about 5%-100% cytidine residues comprising N4-aceytlcytidine) comprises one or more additional modified ribonucleotides. In some embodiments, one or more additional modified ribonucleotides comprises a nucleoside chosen from: an adenosine, a guanosine, a cytidine or a uridine, or a combination thereof. In some embodiments, one or more additional modified ribonucleotides comprises a 5-hydroxymethyl group. In some embodiments, one or more additional modified ribonucleotides comprises 5-hydroxymethyluridine. In some embodiments 5%-100% of uridine residues in a polyribonucleotide comprising uridine are 5-hydroxymethyluridine.

In some embodiments, a polyribonucleotide can have a length of at least 5 nucleotides or longer. In some embodiments, a polyribonucleotide can have a length of at least 5 nucleotides, at least 10 nucleotides, at least 15 nucleotides, at least 20 nucleotides, at least 25 nucleotides, at least 30 nucleotides, at least 35 nucleotides, at least 40 nucleotides, at least 45 nucleotides, at least 50 nucleotides, at least 55 nucleotides, at least 60 nucleotides, at least 65 nucleotides, at least 70 nucleotides, at least 75 nucleotides, at least 80 nucleotides, at least 85 nucleotides, at least 90 nucleotides, at least 95 nucleotides, at least 100 nucleotides, at least 200 nucleotides, at least 300 nucleotides, at least 400 nucleotides, at least 500 nucleotides, at least 1000 nucleotides, at least 2000 nucleotides, at least 5000 nucleotides or longer.

In some embodiments, a polyribonucleotide can have a length of about 5 nucleotides to about 200,000 nucleotides, about 5 nucleotides to about 150,000 nucleotides, about 5 nucleotides to about 100,000 nucleotides, about 5 nucleotides to about 50,000 nucleotides, about 5 nucleotides to about 10,000 nucleotides, about 5 nucleotides to about 5000 nucleotides, about 5 nucleotides to about 1000 nucleotides, about 5 nucleotides to about 500 nucleotides, about 5 nucleotides to about 400 nucleotides, about 5 nucleotides to about 300 nucleotides, about 5 nucleotides to about 200 nucleotides, about 5 nucleotides to about 100 nucleotides, about 5 nucleotides to about 90 nucleotides, about 5 nucleotides to about 85 nucleotides, about 5 nucleotides to about 80 nucleotides, about 5 nucleotides to about 75 nucleotides, about 5 nucleotides to about 70 nucleotides, about 5 nucleotides to about 65 nucleotides, about 5 nucleotides to about 60 nucleotides, about 5 nucleotides to about 55 nucleotides, about 5 nucleotides to about 50 nucleotides, about 5 nucleotides to about 45 nucleotides, about 5 nucleotides to about 40 nucleotides, about 5 nucleotides to about 35 nucleotides, about 5 nucleotides to about 30 nucleotides, about 5 nucleotides to about 25 nucleotides, about 5 nucleotides to about 20 nucleotides, about 5 nucleotides to about 15 nucleotides, about 5 nucleotides to about 10 nucleotides.

In some embodiments, a polyribonucleotide can have a length of about 5 nucleotides to about 200,000 nucleotides, about 10 nucleotides to about 200,000 nucleotides, 15 nucleotides to about 200,000 nucleotides, about 20 nucleotides to about 200,000 nucleotides, about 30 nucleotides to about 200,000 nucleotides, about 40 nucleotides to about 200,000 nucleotides, about 50 nucleotides to about 200,000 nucleotides, about 100 nucleotides to about 200,000 nucleotides, about 200 nucleotides to about 200,000 nucleotides, about 300 nucleotides to about 200,000 nucleotides, about 400 nucleotides to about 200,000 nucleotides, about 500 nucleotides to about 200,000 nucleotides, about 1000 nucleotides to about 200,000 nucleotides, about 2000 nucleotides to about 200,000 nucleotides, about 3000 nucleotides to about 200,000 nucleotides, about 4000 nucleotides to about 200,000 nucleotides, about 5000 nucleotides to about 200,000 nucleotides, about 10,000 nucleotides to about 200,000 nucleotides, about 20,000 nucleotides to about 200,000 nucleotides, about 30,000 nucleotides to about 200,000 nucleotides, about 40,000 nucleotides to about 200,000 nucleotides, about 50,000 nucleotides to about 200,000 nucleotides, about 100,000 nucleotides to about 200,000 nucleotides, about 150,000 nucleotides to about 200,000 nucleotides.

In some embodiments, a polyribonucleotide can have a length of no more than 200,000 nucleotides, no more than 150,000 nucleotides, no more than 100,000 nucleotides, or no more than 50,000 nucleotides.

5-Hydroxymethyl Modified Nucleotides

Among other things, provided herein are polyribonucleotides comprising one or more modified ribonucleotides including a nucleoside comprising a 5-hydroxymethyl group. In some embodiments, a nucleoside of a modified ribonucleotide is 5-hydroxymethyluridine and the modified ribonucleotide has: a 5' monophosphate, a 5' diphosphate or a 5' triphosphate.

In some embodiments, a nucleoside of a modified ribonucleotide is 5-hydroxymethyluridine and the modified ribonucleotide has a structure of:

[Chemical structure: triphosphate-linked 5-hydroxymethyluridine]

In some embodiments, a polyribonucleotide disclosed herein comprises uridine residues. In some embodiments, at least 5% of uridine residues in a polyribonucleotide comprise 5-hydroxymethyluridine. In some embodiments, less than 100% of uridine residues in a polyribonucleotide comprise 5-hydroxymethyluridine.

In some embodiments, a polyribonucleotide disclosed herein comprises uridine residues and at least 5% of uridine residues in a polyribonucleotide comprises 5-hydroxymethyluridine.

In some embodiments, a polyribonucleotide disclosed herein comprises uridine residues and at least 10% of uridine residues in a polyribonucleotide comprises 5-hydroxymethyluridine.

In some embodiments, a polyribonucleotide disclosed herein comprises uridine residues and at least 15% of uridine residues in a polyribonucleotide comprises 5-hydroxymethyluridine.

In some embodiments, a polyribonucleotide disclosed herein comprises uridine residues and at least 20% of uridine residues in a polyribonucleotide comprises 5-hydroxymethyluridine.

In some embodiments, a polyribonucleotide disclosed herein comprises uridine residues and at least 25% of uridine residues in a polyribonucleotide comprises 5-hydroxymethyluridine.

In some embodiments, a polyribonucleotide disclosed herein comprises uridine residues and at least 30% of uridine residues in a polyribonucleotide comprises 5-hydroxymethyluridine.

In some embodiments, a polyribonucleotide disclosed herein comprises uridine residues and at least 35% of uridine residues in a polyribonucleotide comprises 5-hydroxymethyluridine.

In some embodiments, a polyribonucleotide disclosed herein comprises uridine residues and at least 40% of uridine residues in a polyribonucleotide comprises 5-hydroxymethyluridine.

In some embodiments, a polyribonucleotide disclosed herein comprises uridine residues and at least 45% of uridine residues in a polyribonucleotide comprises 5-hydroxymethyluridine.

In some embodiments, a polyribonucleotide disclosed herein comprises uridine residues and at least 50% of uridine residues in a polyribonucleotide comprises 5-hydroxymethyluridine.

In some embodiments, a polyribonucleotide disclosed herein comprises uridine residues and at least 55% of uridine residues in a polyribonucleotide comprises 5-hydroxymethyluridine.

In some embodiments, a polyribonucleotide disclosed herein comprises uridine residues and at least 60% of uridine residues in a polyribonucleotide comprises 5-hydroxymethyluridine.

In some embodiments, a polyribonucleotide disclosed herein comprises uridine residues and at least 65% of uridine residues in a polyribonucleotide comprises 5-hydroxymethyluridine.

In some embodiments, a polyribonucleotide disclosed herein comprises uridine residues and at least 70% of uridine residues in a polyribonucleotide comprises 5-hydroxymethyluridine.

In some embodiments, a polyribonucleotide disclosed herein comprises uridine residues and at least 75% of uridine residues in a polyribonucleotide comprises 5-hydroxymethyluridine.

In some embodiments, a polyribonucleotide disclosed herein comprises uridine residues and at least 80% of uridine residues in a polyribonucleotide comprises 5-hydroxymethyluridine.

In some embodiments, a polyribonucleotide disclosed herein comprises uridine residues and at least 85% of uridine residues in a polyribonucleotide comprises 5-hydroxymethyluridine.

In some embodiments, a polyribonucleotide disclosed herein comprises uridine residues and at least 90% of uridine residues in a polyribonucleotide comprises 5-hydroxymethyluridine.

In some embodiments, a polyribonucleotide disclosed herein comprises uridine residues and at least 95% of uridine residues in a polyribonucleotide comprises 5-hydroxymethyluridine.

In some embodiments, a polyribonucleotide disclosed herein comprises uridine residues and at least 99% of uridine residues in a polyribonucleotide comprises 5-hydroxymethyluridine.

In some embodiments, a polyribonucleotide disclosed herein comprises uridine residues. In some embodiments, about 5% to 99%, about 5% to 95%, about 5% to 90%, about 5% to 85%, about 5% to 80%, about 5% to 75%, about 5% to 70%, about 5% to 65%, about 5% to 60%, about 5% to 55%, about 5% to 50%, about 5% to 45%, about 5% to 40%, about 5% to 35%, about 5% to 30%, about 5% to 25%, about 5% to 20%, about 5% to 15%, about 5% to 10%, about 10% to 99%, about 15% to 99%, about 20% to 99%, about 25% to 99%, about 30% to 99%, about 35% to 99%, about 40% to 99%, about 45% to 99%, about 50% to 99%, about 55% to 99%, about 60% to 99%, about 65% to 99%, about 70% to 99%, about 80% to 99%, about 85% to 99%, about 90% to 99%, or about 95% to 99% of uridine residues in a polyribonucleotide comprises 5-hydroxymethyluridine.

In some embodiments, a polyribonucleotide disclosed herein comprises uridine residues and more than 60% of uridine residues in a polyribonucleotide comprises 5-hydroxymethyluridine.

In some embodiments, a polyribonucleotide disclosed herein comprises uridine residues and more than 65% of uridine residues in a polyribonucleotide comprises 5-hydroxymethyluridine.

In some embodiments, a polyribonucleotide disclosed herein comprises uridine residues and more than 70% of uridine residues in a polyribonucleotide comprises 5-hydroxymethyluridine.

In some embodiments, a polyribonucleotide disclosed herein comprises uridine residues and more than 75% of uridine residues in a polyribonucleotide comprises 5-hydroxymethyluridine.

In some embodiments, a polyribonucleotide disclosed herein comprises uridine residues and more than 80% of uridine residues in a polyribonucleotide comprises 5-hydroxymethyluridine.

In some embodiments, a polyribonucleotide disclosed herein comprises uridine residues and more than 85% of uridine residues in a polyribonucleotide comprises 5-hydroxymethyluridine.

In some embodiments, a polyribonucleotide disclosed herein comprises uridine residues and more than 90% of uridine residues in a polyribonucleotide comprises 5-hydroxymethyluridine.

In some embodiments, a polyribonucleotide disclosed herein comprises uridine residues and more than 95% of uridine residues in a polyribonucleotide comprises 5-hydroxymethyluridine.

In some embodiments, a polyribonucleotide disclosed herein comprises uridine residues and more than 99% of uridine residues in a polyribonucleotide comprises 5-hydroxymethyluridine.

In some embodiments, a polyribonucleotide disclosed herein comprises uridine residues and about 5% of uridine residues in a polyribonucleotide comprises 5-hydroxymethyluridine.

In some embodiments, a polyribonucleotide disclosed herein comprises uridine residues and about 10% of uridine residues in a polyribonucleotide comprises 5-hydroxymethyluridine.

In some embodiments, a polyribonucleotide disclosed herein comprises uridine residues and about 15% of uridine residues in a polyribonucleotide comprises 5-hydroxymethyluridine.

In some embodiments, a polyribonucleotide disclosed herein comprises uridine residues and about 20% of uridine residues in a polyribonucleotide comprises 5-hydroxymethyluridine.

In some embodiments, a polyribonucleotide disclosed herein comprises uridine residues and about 25% of uridine residues in a polyribonucleotide comprises 5-hydroxymethyluridine.

In some embodiments, a polyribonucleotide disclosed herein comprises uridine residues and about 30% of uridine residues in a polyribonucleotide comprises 5-hydroxymethyluridine.

In some embodiments, a polyribonucleotide disclosed herein comprises uridine residues and about 35% of uridine residues in a polyribonucleotide comprises 5-hydroxymethyluridine.

In some embodiments, a polyribonucleotide disclosed herein comprises uridine residues and about 40% of uridine residues in a polyribonucleotide comprises 5-hydroxymethyluridine.

In some embodiments, a polyribonucleotide disclosed herein comprises uridine residues and about 45% of uridine residues in a polyribonucleotide comprises 5-hydroxymethyluridine.

In some embodiments, a polyribonucleotide disclosed herein comprises uridine residues and about 50% of uridine residues in a polyribonucleotide comprises 5-hydroxymethyluridine.

In some embodiments, a polyribonucleotide disclosed herein comprises uridine residues and about 55% of uridine residues in a polyribonucleotide comprises 5-hydroxymethyluridine.

In some embodiments, a polyribonucleotide disclosed herein comprises uridine residues and about 60% of uridine residues in a polyribonucleotide comprises 5-hydroxymethyluridine.

In some embodiments, a polyribonucleotide disclosed herein comprises uridine residues and about 65% of uridine residues in a polyribonucleotide comprises 5-hydroxymethyluridine.

In some embodiments, a polyribonucleotide disclosed herein comprises uridine residues and about 75% of uridine residues in a polyribonucleotide comprises 5-hydroxymethyluridine.

In some embodiments, a polyribonucleotide disclosed herein comprises uridine residues and about 80% of uridine residues in a polyribonucleotide comprises 5-hydroxymethyluridine.

In some embodiments, a polyribonucleotide disclosed herein comprises uridine residues and about 85% of uridine residues in a polyribonucleotide comprises 5-hydroxymethyluridine.

In some embodiments, a polyribonucleotide disclosed herein comprises uridine residues and about 90% of uridine residues in a polyribonucleotide comprises 5-hydroxymethyluridine.

In some embodiments, a polyribonucleotide disclosed herein comprises uridine residues and about 95% of uridine residues in a polyribonucleotide comprises 5-hydroxymethyluridine.

In some embodiments, a polyribonucleotide disclosed herein comprises uridine residues and about 99% of uridine residues in a polyribonucleotide comprises 5-hydroxymethyluridine.

In some embodiments, a polyribonucleotide disclosed herein comprises uridine residues and 100% of uridine residues in a polyribonucleotide comprises 5-hydroxymethyluridine.

In some embodiments, a polyribonucleotide disclosed herein (e.g., a polyribonucleotide comprising uridine residues with about 5%-100% uridine residues comprising 5-hydroxymethyluridine) comprises one or more additional modified ribonucleotides other than 5-hydroxymethyluridine. In some embodiments, one or more additional modified ribonucleotides comprises a nucleoside chosen from: an adenosine, a guanosine, a cytidine or a uridine, or a combination thereof. In some embodiments, one or more additional modified ribonucleotides comprises an acetyl group. In some embodiments, one or more additional modified ribonucleotides comprises N4-aceyticytidine. In some embodiments 5%-100% of cytidine residues in a polyribonucleotide comprising cytidine are N4-aceyticytidine In some embodiments, a polyribonucleotide can have a length of at least 5 nucleotides or longer. In some embodiments, a polyribonucleotide can have a length of at least 5 nucleotides, at least 10 nucleotides, at least 15 nucleotides, at least 20 nucleotides, at least 25 nucleotides, at least 30 nucleotides, at least 35 nucleotides, at least 40 nucleotides, at least 45 nucleotides, at least 50 nucleotides, at least 55 nucleotides, at least 60 nucleotides, at least 65 nucleotides, at least 70 nucleotides, at least 75 nucleotides, at least 80 nucleotides, at least 85 nucleotides, at least 90 nucleotides, at least 95 nucleotides, at least 100 nucleotides, at least 200 nucleotides, at least 300 nucleotides, at least 400 nucleotides, at least 500 nucleotides, at least 1000 nucleotides, at least 2000 nucleotides, at least 5000 nucleotides or longer.

In some embodiments, a polyribonucleotide can have a length of about 5 nucleotides to about 200,000 nucleotides, about 5 nucleotides to about 150,000 nucleotides, about 5 nucleotides to about 100,000 nucleotides, about 5 nucleotides to about 50,000 nucleotides, about 5 nucleotides to about 10,000 nucleotides, about 5 nucleotides to about 5000 nucleotides, about 5 nucleotides to about 1000 nucleotides, about 5 nucleotides to about 500 nucleotides, about 5 nucleotides to about 400 nucleotides, about 5 nucleotides to about 300 nucleotides, about 5 nucleotides to about 200 nucleotides, about 5 nucleotides to about 100 nucleotides, about 5 nucleotides to about 90 nucleotides, about 5 nucleotides to about 85 nucleotides, about 5 nucleotides to about 80 nucleotides, about 5 nucleotides to about 75 nucleotides, about 5 nucleotides to about 70 nucleotides, about 5 nucleotides to about 65 nucleotides, about 5 nucleotides to about 60 nucleotides, about 5 nucleotides to about 55 nucleotides, about 5 nucleotides to about 50 nucleotides, about 5 nucleotides to about 45 nucleotides, about 5 nucleotides to about 40 nucleotides, about 5 nucleotides to about 35 nucleotides, about 5 nucleotides to about 30 nucleotides, about 5 nucleotides to about 25 nucleotides, about 5 nucleotides to about 20 nucleotides, about 5 nucleotides to about 15 nucleotides, about 5 nucleotides to about 10 nucleotides.

In some embodiments, a polyribonucleotide can have a length of about 5 nucleotides to about 200,000 nucleotides, about 10 nucleotides to about 200,000 nucleotides, 15 nucleotides to about 200,000 nucleotides, about 20 nucleotides to about 200,000 nucleotides, about 30 nucleotides to about 200,000 nucleotides, about 40 nucleotides to about 200,000 nucleotides, about 50 nucleotides to about 200,000 nucleotides, about 100 nucleotides to about 200,000 nucleotides, about 200 nucleotides to about 200,000 nucleotides, about 300 nucleotides to about 200,000 nucleotides, about 400 nucleotides to about 200,000 nucleotides, about 500 nucleotides to about 200,000 nucleotides, about 1000 nucleotides to about 200,000 nucleotides, about 2000 nucleotides to about 200,000 nucleotides, about 3000 nucleotides to about 200,000 nucleotides, about 4000 nucleotides to about 200,000 nucleotides, about 5000 nucleotides to about 200,000 nucleotides, about 10,000 nucleotides to about 200,000 nucleotides, about 20,000 nucleotides to about 200,000 nucleotides, about 30,000 nucleotides to about 200,000 nucleotides, about 40,000 nucleotides to about 200,000 nucleotides, about 50,000 nucleotides to about 200,000 nucleotides, about 100,000 nucleotides to about 200,000 nucleotides, about 150,000 nucleotides to about 200,000 nucleotides.

In some embodiments, a polyribonucleotide can have a length of no more than 200,000 nucleotides, no more than 150,000 nucleotides, no more than 100,000 nucleotides, or no more than 50,000 nucleotides.

Compositions

Among other things, the present disclosure provides compositions. Compositions disclosed herein comprise one or more polyribonucleotides comprising one or more modified ribonucleotides comprising a base comprising an acetyl group and/or a 5-hydroxymethyl group. In some embodiments, a nucleoside of a modified ribonucleotide is N4-acetylcytidine. In some embodiments, a nucleoside of a modified ribonucleotide is 5-hydroxymethyluridine.

In some embodiments, a composition comprising one or more polyribonucleotides comprising one or more modified ribonucleotides, e.g., N4-acetylcytidine and/or 5-hydroxymethyluridine, is a pharmaceutical composition.

In some embodiments, a composition comprising one or more polyribonucleotides comprising one or more modified ribonucleotides, e.g., N4-acetylcytidine and/or 5-hydroxymethyluridine, is or comprises an immunogenic composition. An immunogenic composition is a composition that induces an immune response. In some embodiments, an immunogenic composition comprising one or more polyribonucleotides does not itself induce an immune response, but rather the one or more polyribonucleotides encode, e.g., one or more polypeptides that induce an immune response.

In some embodiments, a composition comprising one or more polyribonucleotides comprising one or more modified ribonucleotides, e.g., N4-acetylcytidine and/or 5-hydroxymethyluridine, is or comprises a vaccine.

In some embodiments, a composition comprising one or more polyribonucleotides comprising one or more modified ribonucleotides, e.g., N4-acetylcytidine and/or 5-hydroxymethyluridine, is or comprises an antibody therapy.

In some embodiments, a composition comprising one or more polyribonucleotides comprising one or more modified ribonucleotides, e.g., N4-acetylcytidine and/or 5-hydroxymethyluridine, is or comprises an immune-modulation therapy.

In some embodiments, a composition comprising one or more polyribonucleotides comprising one or more modified ribonucleotides, e.g., N4-acetylcytidine and/or 5-hydroxymethyluridine, is or comprises a gene therapy.

In some embodiments, a composition comprising one or more polyribonucleotides comprising one or more modified ribonucleotides, e.g., N4-acetylcytidine and/or 5-hydroxymethyluridine, is or comprises a chemotherapy.

In some embodiments, a composition comprising one or more polyribonucleotides comprising one or more modified ribonucleotides, e.g., N4-acetylcytidine and/or 5-hydroxymethyluridine, is or comprises a protein replacement therapy.

In some embodiments, a composition comprising one or more polyribonucleotides comprising one or more modified ribonucleotides, e.g., N4-acetylcytidine and/or 5-hydroxymethyluridine, is or comprises an immunotherapy.

In some embodiments, a composition comprising one or more polyribonucleotides comprising one or more modified ribonucleotides, e.g., N4-acetylcytidine and/or 5-hydroxymethyluridine, is or comprises a cell engineering therapy.

In some embodiments, a composition comprising one or more polyribonucleotides comprising one or more modified ribonucleotides, e.g., N4-acetylcytidine and/or 5-hydroxymethyluridine, comprises double stranded RNA. In some embodiments, a composition comprising one or more polyribonucleotides comprising one or more modified ribonucleotides, e.g., N4-acetylcytidine and/or 5-hydroxymethyluridine, does not comprise double stranded RNA.

In some embodiments, a composition comprising a polyribonucleotide disclosed herein is characterized in that when assessed in a cell, tissue or an organism that has been administered the polyribonucleotide, reduces immunogenicity is observed relative to an appropriate reference comparator. In some embodiments, a reference comparator comprises an otherwise similar cell, tissue or organism that has been administered a composition comprising a comparable polyribonucleotide that includes: fewer acetyl groups on a nucleobase and/or fewer 5-hydroxymethyl groups. In some embodiments, a comparable polyribonucleotide is a polyribonucleotide that includes: (i) fewer N4-acetylcytidine nucleosides (e.g., does not include any N4-acetylcytidine nucleosides); and/or (ii) fewer 5-hydroxymethyluridine nucleosides (e.g., does not include any 5-hydroxymethyluridine nucleosides) compared to a polyribonucleotide disclosed herein. In some embodiments, reduced immunogenicity comprises reduced activation of an innate immune response induced toxicity. In some embodiments, reduced activation of an immune response comprises reduced activation of NFkb or an NFkb pathway, IRF or an IRF pathway, and/or other inflammatory cytokines in the cell, tissue or organism. In some embodiments, reduced activation of an immune response comprises reduced detection of uncapped RNA by a molecular sensor, e.g., RIG-I.

In some embodiments, reduced immunogenicity allows for repeated dosing, e.g., administration of at least two doses, of a composition comprising a polyribonucleotide disclosed herein to a cell, tissue or subject. In some embodiments, repeated dosing comprises administration of at least two, at least three, at least four, at least five, at least six, at least seven, at least eight, at least nine or at least ten doses of composition comprising a polyribonucleotide disclosed herein. In some embodiments, repeated dosing comprises administration of a same dose of a composition as compared to a dose of a previous administration of a composition. In some embodiments, repeated dosing comprises administration of a different dose of a composition as compared to a dose of a previous administration of a composition.

In some embodiments, repeated dosing of a composition disclosed herein comprises administering a first dose at a first time point followed by administration of a subsequent dose at a second time point. In some embodiments, a first time point is about 1 day, about 2 days, about 3 days, about 4 days, about 5 days, about 6 days, about 1 week, about 2 weeks, about 3 weeks, about 1 month, about 2 months, about 3 months, about 4 months, about 5 months, about 6 months, about 7 months, about 8 months, about 9 months, about 10 months, about 11 months, or about 12 months prior to a second time point.

In some embodiments, a second or subsequent dose of a composition comprising a polyribonucleotide disclosed herein has a substantially similar efficacy in a cell, tissue or subject compared to a first dose of a composition comprising a polyribonucleotide disclosed herein.

In some embodiments, reduced immunogenicity allows for administration of a higher dose of a composition comprising a polyribonucleotide disclosed herein related to an appropriate reference comparator. In some embodiments, a reference comparator comprises a comparable polyribonucleotide includes fewer acetyl groups on a nucleobase than a polyribonucleotide in a composition. In some embodiments, a reference comparator comprises a comparable polyribonucleotide that includes fewer acetyl groups on a nucleobase and/or fewer 5-hydroxymethyl groups. In some embodiments, a comparable polyribonucleotide is a polyribonucleotide that includes: (i) fewer N4-acetylcytidine nucleosides (e.g., does not include any N4-acetylcytidine nucleosides); and/or (ii) fewer 5-hydroxymethyluridine nucleosides (e.g., does not include any 5-hydroxymethyluridine nucleosides) compared to a polyribonucleotide disclosed herein.

In some embodiments, a composition comprising a polyribonucleotide disclosed herein is characterized in that when assessed in a cell, tissue or an organism that has been administered a polyribonucleotide, increased cell viability is observed relative to an appropriate reference comparator. In some embodiments, a reference comparator is a cell viability of a cell, tissue or organism that has been administered a comparable polyribonucleotide that includes fewer acetyl groups on a nucleobase and/or fewer 5-hydroxymethyl groups. In some embodiments, a comparable polyribonucleotide is a polyribonucleotide that includes: (i) fewer N4-acetylcytidine nucleosides (e.g., does not include any N4-acetylcytidine nucleosides); and/or (ii) fewer 5-hydroxymethyluridine nucleosides (e.g., does not include any 5-hydroxymethyluridine nucleosides) compared to a polyribonucleotide disclosed herein.

In some embodiments, cell viability is a measure of the length of time one or more cells of a cell, tissue or subject live.

In some embodiments, cell viability is a measure of a number of cells of a cell, tissue or subject alive at one or more time points.

In some embodiments, a composition disclosed herein is or comprises an in vitro transcribed polyribonucleotide comprising a modified ribonucleotide disclosed herein.

In some embodiments, a composition disclosed herein is or comprises an expression vector comprising one or more polynucleotides disclosed herein.

In some embodiments, a composition disclosed herein comprises a polyribonucleotide comprising one or more modified ribonucleotides disclosed herein.

In some embodiments, a composition disclosed herein comprises a plurality of polyribonucleotides each comprising one or more modified ribonucleotides disclosed herein. In some embodiments, a composition comprises a plurality of ribonucleotides wherein a first polyribonucleotide comprises a first modified ribonucleotide, and a second polyribonucleotide comprises a second modified ribonucleotide. In some embodiments, a first modified ribonucleotide and a second modified ribonucleotide are the same modified ribonucleotide. In some embodiments, a first modified ribonucleotide and a second modified ribonucleotide are different modified ribonucleotides. In some embodiments, a first polyribonucleotide and/or a second polyribonucleotide further comprises one or more modified nucleotides.

In some embodiments, a composition disclosed herein is administered at a dose of about 5 ng to about 1000 ng, about 5 ng to about 900 ng, about 5 ng to about 800 ng, about 5 ng to about 700 ng, about 5 ng to about 600 ng, about 5 ng to about 500 ng, about 5 ng to about 400 ng, about 5 ng to about 300 ng, about 5 ng to about 200 ng, about 5 ng to about 100 ng, about 5 ng to about 90 ng, about 5 ng to about 80 ng, about 5 ng to about 70 ng, about 5 ng to about 60 ng, about 5 ng to about 50 ng, about 5 ng to about 40 ng, about 5 ng to about 30 ng, about 5 ng to about 20 ng, or about 5 ng to about 10 ng. In some embodiments, a composition disclosed herein is administered at a dose of about 10 ng to about 1000 ng, about 20 ng to about 1000 ng, about 30 ng to about 1000 ng, about 40 ng to about 1000 ng, about 50 ng to about 1000 ng, about 60 ng to about 1000 ng, about 70 ng to about 1000 ng, about 80 ng to about 1000 ng, about 90 ng to about 1000 ng, about 100 ng to about 1000 ng, about 200 ng to about 1000 ng, about 300 ng to about 1000 ng, about 40 ng to about 1000 ng, about 50 ng to about 1000 ng, about 60 ng to about 1000 ng, about 700 ng to about 1000 ng, about 800 ng to about 1000 ng, or about 900 ng to about 1000 ng.

In some embodiments, a composition disclosed herein is administered at a dose of about 5 ng, about 10 ng, about 20 ng, about 30 ng, about 40 ng, about 50 ng, about 60 ng, about 70 ng, about 80 ng, about 90 ng, about 100 ng, 150 ng, about 200 ng, about 250 ng, about 300 ng, about 350 ng, about 400 ng, about 450 ng, about 500 ng, about 550 ng, about 600 ng, about 650 ng, about 700 ng, about 750 ng, about 800 ng, about 850 ng, about 900 ng, about 950 ng, or about 1000 ng.

In some embodiments, a composition disclosed herein is administered at a dose of at least 5 ng, at least 10 ng, at least 20 ng, at least 30 ng, at least 40 ng, at least 50 ng, at least 60 ng, at least 70 ng, at least 80 ng, at least 90 ng, at least 100 ng, at least 150 ng, at least 200 ng, at least 250 ng, at least 300 ng, at least 350 ng, at least 400 ng, at least 450 ng, at least 500 ng, at least 550 ng, at least 600 ng, at least 650 ng, at least 700 ng, at least 750 ng, at least 800 ng, at least 850 ng, at least 900 ng, at least 950 ng, or at least 1000 ng.

Pharmaceutical Compositions

In some embodiments, a composition comprising one or more polyribonucleotides comprising one or more modified ribonucleotides, e.g., N4-acetylcytidine and/or 5-hydroxymethyluridine, is a pharmaceutical composition. In some embodiments, a pharmaceutical composition further comprises a pharmaceutically acceptable excipient. Pharmaceutical compositions of the present disclosure may comprise a polypeptide disclosed herein, a polynucleotide disclosed herein, or an expression vector comprising a polynucleotide disclosed herein.

In some embodiments, a pharmaceutical composition can include a pharmaceutically acceptable carrier or excipient, which, as used herein, includes any and all solvents, dispersion media, diluents, or other liquid vehicles, dispersion or suspension aids, surface active agents, isotonic agents, thickening or emulsifying agents, preservatives, solid binders, lubricants and the like, as suited to the particular dosage form desired. Remington's The Science and Practice of Pharmacy, 21st Edition, A. R. Gennaro (Lippincott, Williams & Wilkins, Baltimore, Md., 2006; incorporated herein by reference) discloses various excipients used in formulating pharmaceutical compositions and known techniques for the preparation thereof. Suitable pharmaceutically acceptable carriers include but are not limited to water, salt solutions (e.g., NaCl), saline, buffered saline, glycerol, sugars such as mannitol, sucrose, or others, dextrose, fatty acid esters, etc., as well as combinations thereof.

A pharmaceutical composition can, if desired, be mixed with auxiliary agents (e.g., lubricants, preservatives, stabilizers, wetting agents, emulsifiers, salts for influencing osmotic pressure, buffers, coloring, flavoring and/or aromatic substances and the like), which do not deleteriously react with the active compounds or interfere with their activity. In certain embodiments, a water-soluble carrier suitable for intravenous administration is used. In some embodiments, a pharmaceutical composition can be sterile.

A suitable pharmaceutical composition, if desired, can also contain minor amounts of wetting or emulsifying agents, or pH buffering agents. A pharmaceutical composition can be a liquid solution, suspension, or emulsion.

A pharmaceutical composition can be formulated in accordance with the routine procedures as a pharmaceutical composition adapted for administration to human beings. The formulation of a pharmaceutical composition should suit the mode of administration. For example, in some embodiments, a composition for intravenous administration is typically a solution in sterile isotonic aqueous buffer. Where necessary, the composition may also include a solubilizing agent and a local anesthetic to ease pain at the site of the injection. Generally, the ingredients are supplied either separately or mixed together in unit dosage form, for example, as a dry lyophilized powder or water free concentrate in a hermetically sealed container such as an ampule or sachet indicating the quantity of active agent. Where a pharmaceutical composition is to be administered by infusion, it can be dispensed with an infusion bottle containing sterile pharmaceutical grade water, saline or dextrose/water. Where a pharmaceutical composition is administered by injection, an ampule of sterile water for injection or saline can be provided so that the ingredients may be mixed prior to administration.

Although the descriptions of pharmaceutical compositions provided herein are principally directed to pharmaceutical compositions that are suitable for ethical administration to humans, it will be understood by the skilled artisan that such compositions are generally suitable for administration to animals of all sorts or cells in vitro or ex vivo. Modification of pharmaceutical compositions suitable for administration to humans in order to render the compositions suitable for administration to various animals or cells in vitro or ex vivo is well understood, and the ordinarily skilled practitioner, e.g., a veterinary pharmacologist, can design and/or perform such modification with merely ordinary, if any, experimentation.

Formulations of the pharmaceutical compositions described herein may be prepared by any method known or hereafter developed in the art of pharmacology. In general, such preparatory methods include the step of bringing the active ingredient into association with a diluent or another excipient and/or one or more other accessory ingredients, and then, if necessary and/or desirable, shaping and/or packaging the product into a desired single- or multi-dose unit.

A pharmaceutical composition in accordance with the present disclosure may be prepared, packaged, and/or sold in bulk, as a single unit dose, and/or as a plurality of single unit doses. As used herein, a "unit dose" is discrete amount of a pharmaceutical composition described herein.

RNA Formulations

Among other things, provided herein are compositions comprising polyribonucleotides comprising N4-acetylcytidine and/or 5-hydroxymethyluridine, and formulations thereof. In some embodiments, a composition comprising a polyribonucleotide disclosed herein is formulated in a lipid nanoparticle (LNP) formulation.

In some embodiments, a polyribonucleotide disclosed herein encodes for a polypeptide. In some embodiments, a polyribonucleotide disclosed herein is or comprises a messenger RNA. In some embodiments, a composition comprising a polyribonucleotide comprising a messenger RNA is formulated in a lipid nanoparticle (LNP) formulation.

In some embodiments, a polyribonucleotide disclosed herein is or comprises a gRNA. In some embodiments, a composition comprising a polyribonucleotide comprising a gRNA is formulated in a lipid nanoparticle (LNP) formulation.

In some embodiments, a polyribonucleotide disclosed herein is or comprises an inhibitory RNA. In some embodiments, a composition comprising a polyribonucleotide comprising an inhibitory RNA is formulated in a lipid nanoparticle (LNP) formulation.

In some embodiments, a polyribonucleotide disclosed herein is or comprises an miRNA or siRNA. In some embodiments, a composition comprising a polyribonucleotide comprising a miRNA or siRNA is formulated in a lipid nanoparticle (LNP) formulation.

In some embodiments, a polyribonucleotide disclosed herein is or comprises an antisense oligonucleotide. In some embodiments, a composition comprising a polyribonucleotide comprising an antisense oligonucleotide is formulated in a lipid nanoparticle (LNP) formulation.

In some embodiments, the disclosure provides an LNP formulation comprising a polyribonucleotide disclosed herein for use in a pharmaceutical composition, e.g., an immunogenic composition.

Methods of Using Compositions Disclosed Herein

The disclosure provides, among other things, methods for using a polyribonucleotide disclosed herein, or a composition comprising the same.

In some embodiments, provided herein is a method of administering a polyribonucleotide disclosed herein or a composition comprising a polyribonucleotide disclosed herein to a cell, tissue or subject.

In some embodiments, provided herein is a vaccination method comprising administering a polyribonucleotide disclosed herein or a composition comprising a polyribonucleotide disclosed herein to a cell, tissue or subject.

In some embodiments, disclosed herein is an antibody therapy method comprising administering a polyribonucleotide disclosed herein or a composition comprising a polyribonucleotide disclosed herein to a cell, tissue or subject. In some embodiments, an antibody therapy comprises a fragment comprising an antigen-recognition domain (e.g., an scFv, a Fab or other fragments), or an intact antibody, or a polypeptide comprising antigen binding specificity fused to an Fc. In some embodiments, an antibody therapy comprises a bispecific, a multi-specific, a heterodimer, a Crossmab, a DVD-Ig, a 2 in 1 IgG, an IgG-sc-FV, an scFv-scFv, a BiTE, a DART, a diabody, a Fab-scFv fusion, a Fab-Fab fusion, a tandem antibody, or any other art recognized antibody formats.

In some embodiments, disclosed herein is an immune-modulation therapy comprising administering a polyribonucleotide disclosed herein or a composition comprising a polyribonucleotide disclosed herein to a cell, tissue or subject. In some embodiments, an immune-modulation therapy comprises: a cytokine or a variant or fragment thereof, a chemokine or a variant or fragment thereof, a T-cell modulator, an NK cell modulator, a B cell modulator, a myeloid cell modulator, a modulator of any other immune cell, or a combination thereof. In some embodiments, an immune-modulation therapy comprises a chimeric antigen receptor (CAR) therapy. In some embodiments, an immune-modulation therapy, comprises an engineered T cell receptor (TCR) therapy.

In some embodiments, disclosed herein is a gene therapy method comprising administering a polyribonucleotide disclosed herein or a composition comprising a polyribonucleotide disclosed herein to a cell, tissue or subject. In some embodiments, a gene therapy method comprises delivery of one or more components of a gene therapy, e.g., a guide RNA and/or a Cas polypeptide.

In some embodiments, provided herein is a method for stimulating an immune response comprising administering a polyribonucleotide disclosed herein or a composition comprising a polyribonucleotide disclosed herein to a cell, tissue or subject.

In some embodiments, also provided herein is a cell therapy engineering method comprising administering a polyribonucleotide disclosed herein or a composition comprising a polyribonucleotide disclosed herein to a cell, tissue or subject.

In some embodiments, provided herein is an immunotherapy method comprising administering a polyribonucleotide disclosed herein or a composition comprising a polyribonucleotide disclosed herein to a cell, tissue or subject. In some embodiments, an immunotherapy method comprises delivery of an immune-modulation therapy and/or an immune checkpoint therapy.

In some embodiments, disclosed herein is a protein replacement therapy method comprising administering a polyribonucleotide disclosed herein or a composition comprising a polyribonucleotide disclosed herein to a cell, tissue or subject. In some embodiments, a protein replacement therapy comprises delivery of an enzyme replacement therapy.

In some embodiments, provided herein is a chemotherapeutic method comprising administering a polyribonucleotide disclosed herein or a composition comprising a polyribonucleotide disclosed herein to a cell, tissue or subject.

In some embodiments, a method or use disclosed herein comprises determining cell viability of a cell, tissue or subject. In some embodiments, cell viability is a measure of a length of time one or more cells of a cell, tissue or subject live. In some embodiments, cell viability is a measure of a number of cells of a cell, tissue or subject alive at one or more time points.

In some embodiments, a cell, tissue or subject to which a polyribonucleotide or a composition comprising the same has been administered exhibits improved cell viability as compared to a reference cell viability. In some embodiments, a reference cell viability is a cell viability of a cell, tissue or subject that has been administered a comparable polyribonucleotide or a composition comprising the same that includes fewer acetyl groups on a nucleobase and/or fewer 5-hydroxymethyl groups. In some embodiments, a comparable polyribonucleotide is a polyribonucleotide that includes: (i) fewer N4-acetylcytidine nucleosides (e.g., does not include any N4-acetylcytidine nucleosides); and/or (ii) fewer 5-hydroxymethyluridine nucleosides (e.g., does not include any 5-hydroxymethyluridine nucleosides) compared to a polyribonucleotide disclosed herein.

In some embodiments, a method or use disclosed herein further comprises determining an immune system response of a cell, tissue or subject to which a polyribonucleotide or a composition comprising the same has been administered. In some embodiments, an immune response comprises an innate immune system response comprising innate immune system induced toxicity. In some embodiments, determining an innate immune system response comprises determining a level and/or activation of NF-κB or an NF-κB pathway; IRF or an IRF pathway; or inflammatory cytokines, or a combination thereof in a cell, tissue or subject. In some embodiments, determining an innate immune system response comprises determining a level of uncapped RNA detection in a cell, tissue or subject.

In some embodiments, a cell, tissue or subject to which a polyribonucleotide or a composition comprising the same has been administered exhibits a reduced innate immune system response as compared to a reference. In some embodiments, a reference is an innate immune system response of a cell, tissue or subject that has been administered a comparable polyribonucleotide or a composition comprising the same that includes fewer acetyl groups on a nucleobase and/or fewer 5-hydroxymethyl groups. In some embodiments, a comparable polyribonucleotide is a polyribonucleotide that includes: (i) fewer N4-acetylcytidine nucleosides (e.g., does not include any N4-acetylcytidine nucleosides); and/or (ii) fewer 5-hydroxymethyluridine nucleosides (e.g., does not include any 5-hydroxymethyluridine nucleosides) compared to a polyribonucleotide disclosed herein.

In some embodiments, a method or use disclosed herein further comprises determining efficacy of a polyribonucleotide or a composition comprising the same in a cell, tissue or subject to which a polyribonucleotide or a composition comprising the same has been administered.

In some embodiments, determining efficacy comprises determining an antibody response or cellular response in a cell, tissue or subject. In some embodiments, a cell, tissue or subject to which a polyribonucleotide or a composition comprising the same has been administered exhibits an increased antibody response or cellular response as compared to a reference. In some embodiments, a reference is an antibody response or cellular response of a cell, tissue or subject that has been administered a comparable polyribonucleotide or a composition comprising the same that includes: (i) fewer N4-acetylcytidine nucleosides (e.g., does not include any N4-acetylcytidine nucleosides); and/or (ii) fewer 5-hydroxymethyluridine nucleosides (e.g., does not include any 5-hydroxymethyluridine nucleosides) compared to a polyribonucleotide disclosed herein.

In some embodiments, a method or use disclosed herein comprises administering a polyribonucleotide or a composition comprising the same to a cell, tissue or subject at least two times. In some embodiments, a method disclosed herein comprises administering a polyribonucleotide or a composition comprising the same to a cell, tissue or subject at least 2 times, at least 3 times, at least 4 times, at least 5 times, at least 6 times, at least 7 times, at least 8 times, at least 9 times or at least 10 times.

In some embodiments, a method or use disclosed herein comprises administering a plurality of doses of a polyribonucleotide or a composition comprising the same to a cell, tissue or subject. In some embodiments, a second or subsequent dose of a polyribonucleotide or a composition comprising the same has a substantially similar efficacy in a cell, tissue, or subject compared to administration of a first dose of a composition comprising a polyribonucleotide.

In some embodiments of any of the methods or uses disclosed herein, a polyribonucleotide or a composition comprising the same is administered to a cell, tissue or subject at a higher dose compared to an appropriate reference comparator. In some embodiments, a reference comparator comprise a comparable polyribonucleotide that includes fewer acetyl groups on a nucleobase and/or fewer 5-hydroxymethyl groups. In some embodiments, a comparable polyribonucleotide is a polyribonucleotide that includes: (i) fewer N4-acetylcytidine nucleosides (e.g., does not include any N4-acetylcytidine nucleosides); and/or (ii) fewer 5-hydroxymethyluridine nucleosides (e.g., does not include any 5-hydroxymethyluridine nucleosides) compared to a polyribonucleotide disclosed herein.

In some embodiments of any of the methods or uses disclosed herein, the composition is administered via any one of the following routes of administration: intramuscular, intravenous, subcutaneous, intrathecal, intradermal, ocular, intranasal, sublingual, or oral.

In some embodiments of any of the methods or uses disclosed herein a cell is a mammalian cell.

In some embodiments of any of the methods or uses disclosed herein a tissue is a mammalian tissue.

In some embodiments of any of the methods or uses disclosed herein, a subject is a mammal. In some embodiments, a mammal is a human.

Kits

Another aspect of the present disclosure further provides a pharmaceutical pack or kit. In some embodiments, a kit can comprise a polyribonucleotide or a composition described herein. In some embodiment, kits may be used in any applicable method, e.g., methods as described herein.

EXEMPLIFICATION

Example 1: Reduced Immunogenicity and Improved Efficacy of RNA Comprising N4-Acetylcytidine This Example shows that use of an RNA comprising N4-acetylcytidine (Ac4C) in place of natural cytidine can reduce undesired immunogenicity that is associated with in vitro transcribed RNAs.

Methods

IVT Template production: For experiments using Luc2 RNA, the luc2 gene encoding an optimized version of firefly luciferase was amplified from pGL4.10[luc2] (Promega). Amplification was carried out at an annealing temperature of 70° C. in a 20 µL reaction consisting of 0.25 µM each primer Luc2_fwd and Luc2_rev, 1× Herculase II buffer, 25 mM each dNTP, 30 ng pGL4.10[luc2] plasmid (Promega), 0.25M Betaine and 0.4 µL Herculase II enzyme. PCR product was purified using a 0.8× ratio of SpriSelect beads (Beckman Coulter) to PCR reaction volume and eluted into 45 µL Nuclease free water. 42.5 uL of the eluted product was subjected to treatment with 125 U of Dpn1 enzyme (New England Biolabs) in a 50 µL reaction to digest template plasmid. The digested product was purified using a 0.65× ratio of SpriSelect beads (Beckman Coulter) to digest reaction volume and eluted into 40 µL nuclease free water. This digested, primary PCR product was then amplified at 50 C in a 20 µL reaction consisting of 0.25 µM each primer T7-AGG_fwd and 120pA_rev, 1× Herculase II buffer, 25 mM each dNTP, 10 ng Luc2 primary amplification product, and 0.4 µL Herculase II enzyme. This secondary PCR product was cleaned up using a 0.8× ratio of SpriSelect beads (Beckman Coulter) to PCR reaction volume and eluted into 10 mM Tris-HCl pH 8.5.

The sequences of primers used were as follows:

```
Luc2_fwd:
                                          (SEQ ID NO: 1)
CTTGTTCTTT TTGCAGAAGC TCAGAATAAA CGCTCAACTT TGGCCACCat ggaagatgcc aaaaacatta agaagggc Luc2_rev
                                          (SEQ ID NO: 2)
AGAATGTGAA GAAACTTTCT TTTTATTAGG AGCAGATACG

AATGGCTACA TTTTGGGGGA CAACATTTTG TAAAGTGTAA

GTTGGTATTA TGTAGCTTAG AGACTCCATT CGGGTGTTCT

TGAGGCTGGT CTATCATTAc acggcgatct tgccgcc

T7-AGG_fwd
                                          (SEQ ID NO: 3)
gaattTAATA CGACTCACTA TAAGGcttgt tcttttgca gaagc 120pA_rev
                                          (SEQ ID NO: 4)
TTTTTTTTTT TTTTTTTTTT TTTTTTTTTT TTTTTTTTTT

TTTTTTTTTT TTTTTTTTTT TTTTTTTTTT TTTTTTTTTT

TTTTTTTTTT TTTTTTTTTT TTTTTTTTTT TTTTTTTTTT agaatgtgaa gaaactttct ttttattag
```

For experiments testing RNA vaccine candidates, the DNA sequence encoding the design candidate was order as a gblock (IDT). Gblocks were resuspended to a concentration of 20 ng/uL in 10 mM Tris-HCl pH 8.5. T7 templates were generated by PCR amplification at 50 C in a 20 µL reaction consisting of 0.25 µM each primer T7-AGG_fwd and 120pA_rev, 1× Herculase II buffer, 25 mM each dNTP, 10 ng Gblock, and 0.4 µL Herculase II enzyme. This PCR product was cleaned up using a 0.8× ratio of SpriSelect beads (Beckman Coulter) to PCR reaction volume and eluted into 10 mM Tris-HCl pH 8.5.

The sequences of primers used were as follows:

```
T7-AGG_fwd
                                        (SEQ ID NO: 3)
gaattTAATA CGACTCACTA TAAGGcttgt tcttttgca gaagc 120pA_rev
                                        (SEQ ID NO: 4)
TTTTTTTTTT TTTTTTTTTT TTTTTTTTTT TTTTTTTTTT

TTTTTTTTTT TTTTTTTTTT TTTTTTTTTT TTTTTTTTTT

TTTTTTTTTT TTTTTTTTTT TTTTTTTTTT TTTTTTTTTT agaatgtgaa gaaactttct ttttattag
```

In vitro transcription (IVT) of Luc2 RNA for A549 Assays: Luc2 RNA was synthesized in 20 µL IVT reactions consisting of 200 ng Luc2 T7 template, 20 mM MgCl2, 7.5 mM each NTP, 7.5 mM CleanCap AG (TriLink), 1× HiScribe Transcription Buffer, and 2 uL HiScribe polymerase mix (NEB) and incubated at 37° C. for 1 hour. To test the effect of a gradient of increasing percentage substitution with N4-acetylcytidine, the corresponding percentage of CTP was replaced with Ac4CTP (Jena BioScience) in the IVT mixture.

All IVT products were cleaned up using Monarch 500 µg RNA Clean Up kit (NEB) and eluted into 88 µL nuclease-free water. Eluted products were then digested in 100 µL reactions consisting of 1× DNase I buffer and 10 U of DNase I (RNase-free) (New England Biolabs) at 37° C. for 10 minutes to degrade DNA template. DNase I treated samples were cleaned up using Monarch 500 ug RNA Clean Up kit (New England Biolabs) and eluted into 88 µL nuclease-free water.

The DNAse I treated products, which have a co-transcriptionally added Cap 1 structure, were treated with 1× CutSmart buffer and 25 U Quick CIP (NEB) at 37 C for 5 min as a polishing step to remove rare immunogenic 5' triphosphates from RNA transcripts that did not incorporate CleanCap AG.

Quick CIP treated RNAs were cleaned up using Monarch 500 ug RNA Clean Up kit (NEB) and eluted into 1 mM sodium citrate, pH 6.5.

RNA Quantification: RNA concentration was determined using a NanoDrop OneC spectrophotometer (Thermo Scientific).

A549 Cell Culture Methods: A549-Dual (InvivoGen) were cultured in high glucose GlutaMAX Dulbecco's Modified Eagle Medium supplemented with 10% heat-inactivated fetal bovine serum, 100 units/mL penicillin, 100 µg/mL streptomycin, 10 µg/mL blasticidin, and 100 µg/mL zeocin and maintained at 37° C. and 5% $CO_2$.

Cells were plated to a 96-well at 2,000 cells/well 1 day prior to transfection. 50 ng of each RNA were transfected using Lipofectamine MessengerMAX Transfection Reagent (ThermoFisher) using a 1:1.5 µg:µL ratio of RNA:MessengerMAX. Transfections were performed in triplicate.

Viability and luciferase expression were determined using the ONE-Glo+Tox Luciferase Reporter and Cell Viability Assay (Promega). NF-κB activation was measured via the SEAP reporter gene using the QUANTI-Blue detection reagent (InvivoGen) as described by the manufacturer. The IRF pathway activation was measured via the activity of Lucia luciferase gene using QUANTI-Luc detection reagent (InvivoGen) as described by the manufacturer.

In vitro transcription (IVT) of Luc2 RNA for In Vivo Experiments: Luc2 RNA was synthesized in 20 µL IVT reactions consisting of 200 ng Luc2 T7 template, 20 mM MgCl2, 7.5 mM each NTP, 7.5 mM CleanCap AG (TriLink), 1× HiScribe Transcription Buffer, and 2 uL HiScribe polymerase mix (NEB) and incubated at 37° C. for 1 hour. For RNA conditions using chemically modified nucleotides, either UTP was substituted with N1-MethylpseudoUTP (TriLink) or cytidine was substituted with N4-acetylCTP (Jena BioScience) at the indicated ratio in the IVT mixture.

All IVT products were cleaned up using Monarch 500 µg RNA Clean Up kit (NEB) and eluted into 88 µL nuclease-free water. Eluted products were then digested in 100 µL reactions consisting of 1× DNase I buffer and 10 U of DNase I (RNase-free) (New England Biolabs) at 37° C. for 10 minutes to degrade DNA template. DNase I treated samples were cleaned up using Monarch 500 ug RNA Clean Up kit (New England Biolabs) and eluted into 88 µL nuclease-free water.

The DNAse I treated products, which have a co-transcriptionally added Cap 1 structure, we treated with 1× CutSmart buffer and 25 U Quick CIP (NEB) at 37 C for 5 min as a polishing step to remove low frequency immunogenic 5' triphosphates from RNA transcripts that did not incorporate CleanCap AG.

Quick CIP treated RNAs were cleaned up using Monarch 500 ug RNA Clean Up kit (NEB) and eluted into 1 mM sodium citrate, pH 6.5.

In vitro transcription (IVT) of RNA Vaccine candidates: RNA vaccine candidate was synthesized in 20 µL IVT reactions consisting of 200 ng Luc2 T7 template, 20 mM MgCl2, 7.5 mM each NTP, 7.5 mM CleanCap AG (TriLink), 1× HiScribe Transcription Buffer, and 2 uL HiScribe polymerase mix (NEB) and incubated at 37° C. for 1 hour. For RNA conditions using chemically modified nucleotides, either UTP was substituted with N1-MethylpseudoUTP (TriLink) or cytidine was substituted with N4-acetylCTP (Jena BioScience) at the indicated ratio in the IVT mixture.

All IVT products were cleaned up using Monarch 500 µg RNA Clean Up kit (NEB) and eluted into 88 µL nuclease-free water. Eluted products were then digested in 100 µL reactions consisting of 1× DNase I buffer and 10 U of DNase I (RNase-free) (New England Biolabs) at 37° C. for 10 minutes to degrade DNA template. DNase I treated samples were cleaned up using Monarch 500 ug RNA Clean Up kit (New England Biolabs) and eluted into 88 µL nuclease-free water.

The DNAse I treated products, which have a co-transcriptionally added Cap 1 structure, we treated with 1× CutSmart buffer and 25 U Quick CIP (NEB) at 37 C for 5 min as a polishing step to remove low frequency immunogenic 5' triphosphates from RNA transcripts that did not incorporate CleanCap AG.

Quick CIP treated RNAs were cleaned up using Monarch 500 ug RNA Clean Up kit (NEB) and eluted into 1 mM sodium citrate, pH 6.5.

Formulation for In Vivo RNA experiments: Formulations of RNA in lipid nanoparticles (RNA-LNPs) were prepared using a microfluidic mixer (Precision Nanosystems, Vancouver, BC). Briefly, GenVoy-ILM lipid mixture (Precision Nanosystems NWW0042) was diluted to 12.5 mM in anhydrous ethanol, and combined with an aqueous solution of RNA (0.14 mg/mL) in PNI buffer (Precision Nanosystems NWW0043), using the manufacturer-recommended formulation parameters. Formulations were immediately diluted 30:1 in phosphate-buffered saline (Gibco 10010023), concentrated using Amicon centrifugation filters (MilliporeSigma UFC901008), and adjusted to the appropriate final volume with PBS. Formulations were stored at 4° C. for up to 8 days prior to in vivo administration.

Repeat dose RNA administration study in mice: Animal experiments were carried out in accordance with the guidelines set forth by Charles River Accelerator Development Lab (CRADL, Cambridge, Mass., USA) and were approved by the CRADL Institutional Animal Care and Use (IACUC) committee. Female BALB/C mice (7-9 weeks old) were purchased from Charles River Laboratories (Wilmington, Mass., USA) and housed at CRADL. Mice (n=4 per condition) were acclimated for 3 days before the initiation of the study. During the course of the repeat dose Luc2 study, animals received three RNA administrations at 72 hour intervals, and were imaged via whole body bioluminescence imaging at 6 hours, 27 hours and 51 hours following each RNA administration. All RNA injections consisted of 200 uL RNA-LNP formulation (1 ug Luc2 RNA dose per animal) delivered via tail vein injection. For whole body bioluminescence imaging, animals were injected with 200 uL of D-luciferin K+ salt (PerkinElmer 122799) diluted to 15 mg/mL in PBS, via intraperitoneal (IP) injection, 10 minutes prior to the imaging time point. Three minutes prior to imaging, mice were placed under 3% isoflurane anesthesia in an induction chamber, then moved to isoflurane-delivering nosecones in the imaging chamber (IVIS-Spectrum Model 124262; Perkin Elmer, Waltham, Mass.) immediately prior to imaging. Mice were positioned ventral side up in the imaging chamber, and were maintained on 3% isoflurane throughout imaging. Images were acquired using field of view D and continued to be exposed until 30,000 photons were collected or 1 min has passed, whichever occurred first. After imaging, animals were returned to their home cage for recovery. Mice were euthanized 72 hours following the third RNA administration, at which time blood was collected via intracardiac stick. Serum was separated from blood in Mini-Collect serum separator tubes (Greiner Bio-One 450472) by centrifugation at 4° C., 1200×g, for 10 minutes. Aliquots of fresh serum were stored at 4° C. for less than 24 hours then shipped on ice to IDEXX BioAnalytics (North Grafton, Mass.) for a mouse liver panel test (code 60405). Aliquots of serum frozen at −80° C. were shipped on dry ice to IDEXX BioAnalytics (Columbia, Mo.) for a mouse cytokine 25-plex panel test (code 62579).

Vaccine Immunogenicity Screening in Mice: All animal experiments were carried out in accordance with the guidelines set forth by Charles River Accelerator Development Lab (CRADL, Cambridge, Mass., USA) and were approved by the CRADL Institutional Animal Care and Use (IACUC) committee. Female BALB/C mice (7-9 weeks old) were purchased from Charles River Laboratories (Wilmington, Mass., USA) and housed at CRADL. Mice (n=4 per condition) were acclimated for 3 days before the initiation of the study. On Day 1, mice were injected in the right quadriceps with 50 uL RNA-LNP formulation (10 ug RNA dose per animal). On Day 4, mice were injected in the left quadriceps with 50 uL of the same RNA-LNP formulation used for prime administration (again 10 ug dose per animal). On Day 11, mice were euthanized, at which time blood was collected via intracardiac stick. Serum was separated from blood in MiniCollect serum separator tubes (Greiner Bio-One 450472) by centrifugation at 4° C., 1200×g, for 10 minutes. Fresh serum was stored at 4° C. and used to evaluate immunogenicity by ELISA, the remainder was aliquoted and frozen at −80° C. Aliquots of serum frozen at −80° C. were shipped on dry ice to IDEXX BioAnalytics (Columbia, Mo.) for a mouse cytokine 25-plex panel test (code 62579).

Results:

The work described in this Example demonstrates that use of N4-acetylcytidine (Ac4C) in place of natural cytidine can reduce undesired immunogenicity that is associated with in vitro transcribed RNAs. Table 1 shows that nucleotides were readily accepted by T7 RNA polymerase for incorporation into in vitro transcribed RNAs. As shown herein, the reduced immunogenicity and improved cell viability from Ac4C substitution increased the therapeutic potency of the RNA product.

TABLE 1

| % Ac4C Substitution | RNA concentration (ng/µL) |
|---|---|
| 0% | 1241.2 |
| 10% | 1116.4 |
| 25% | 1008.4 |
| 50% | 948.9 |
| 75% | 970.3 |
| 100% | 1019.9 |

The substantial improvement in cell viability was apparent from the data presented in FIG. 1. This trend in viability improvement followed a similar trend in the reduction of both immunogenicity markers, NF-κB and IRF, as demonstrated in FIGS. 2 and 3. Taken together, increasing the percent substitution of Ac4C reduced the toxicity of exogenous RNA, which in some embodiments, translated to better patient tolerability of RNA therapeutics incorporating Ac4C.

Figure 4:
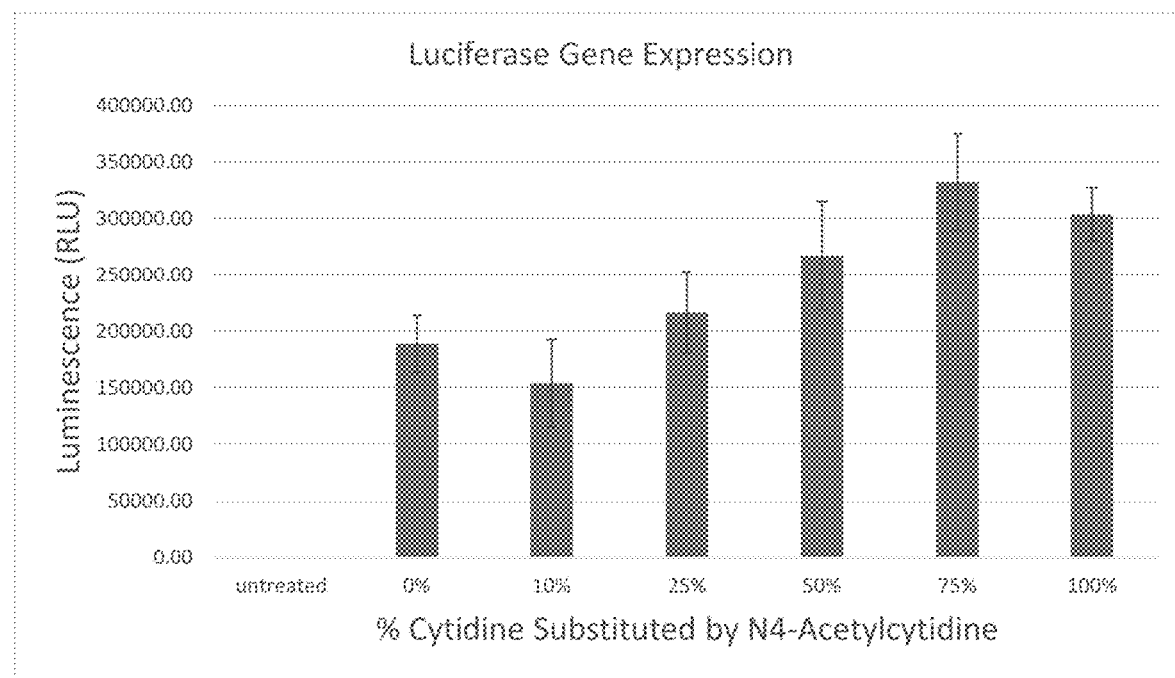
FIG. 4 is a graph showing luciferase gene expression by RNA synthesized using the indicated percentage of N4-Acetylcytidine instead of unmodified cytidine.
Figure 5:
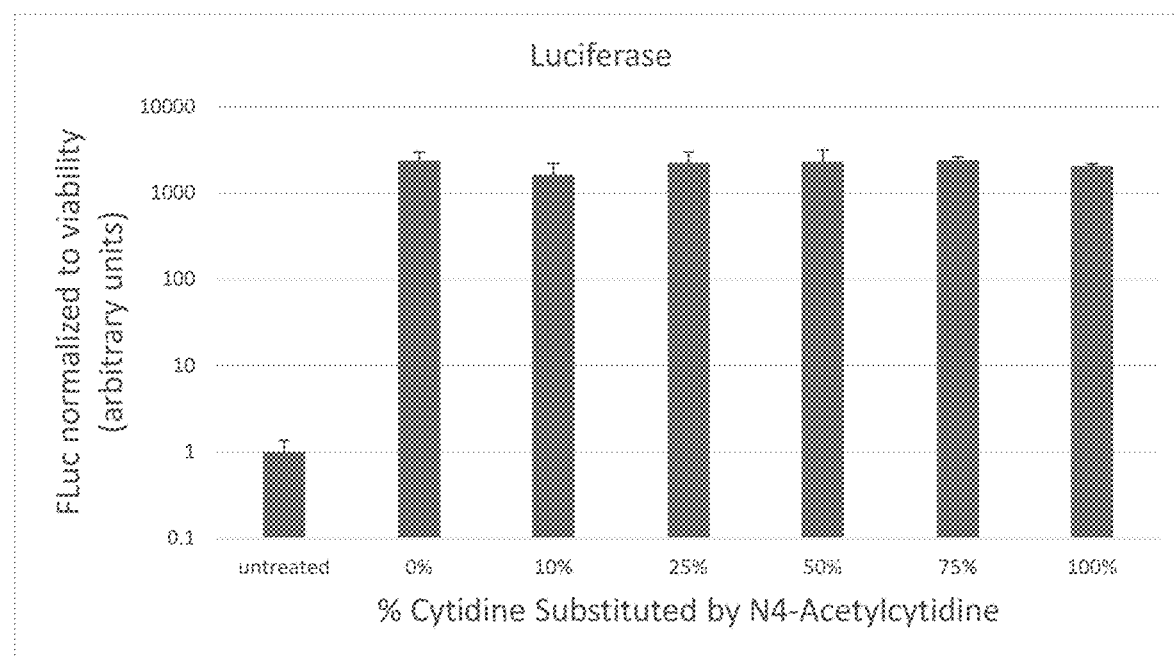
FIG. 5 is a graph showing luciferase gene expression normalized to cell viability by RNA synthesized using the indicated percentage of N4-Acetylcytidine instead of unmodified cytidine.

Contrary to the data shown in Arango, et al., FIGS. 4 and 5 show that reporter gene expression was in fact lower when cytidine is fully substituted with Ac4C. The trade-off between reduced immunogenicity and increased protein expression can be accounted for when determining the ideal percentage of Ac4C to use. The ideal percentage for expression will likely depend, e.g., on the codon composition of the RNA in question. This phenomenon of ideal percent substitution of Ac4C depending on application was apparent from the in vivo experiments described herein.

Figure 6:
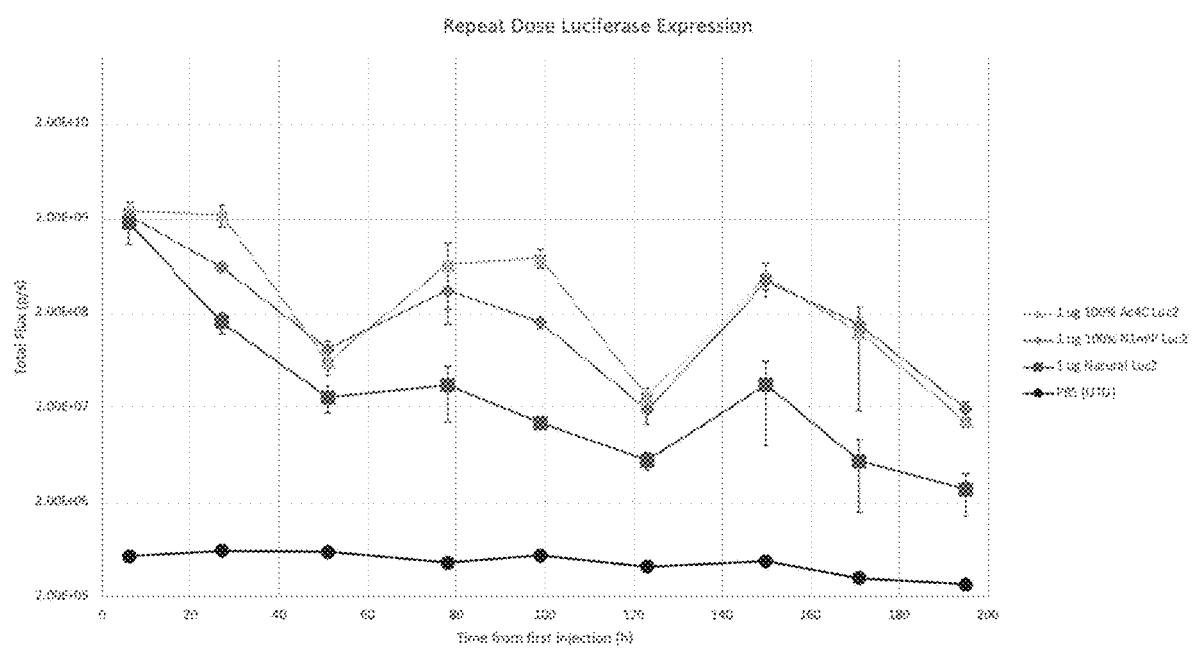
FIG. 6 is a graph depicting the time course of luciferase expression with repeated dosing in BALb/c mice with luciferase RNA having the indicated chemical modifications and synthesized at the indicated IVT synthesis temperature. Mice received three doses of the RNA formulated in LNPs. Each dose was separated by 72 hours and at 6, 27, and 51 hours after administration of each dose, mice were imaged for luciferase expression. The x-axis provides the time point information. For example, 1.6, 1.27 and 1.51 indicate 6 hours, 27 hours and 51 hours after administration of the first dose. The same is provided for time points after the second dose (see 2.6, 2.27 and 2.51 time points) and after the third dose (see 3.6, 3.27 and 3.51 time points).

Due to the strong reduction in immunogenicity conferred by full substitution of Ac4C, RNA fully modified with Ac4C was well suited for repeated dosing of a therapeutic protein. As shown in FIG. 6, RNA fully modified with Ac4C (100% Ac4c 37 C) in fact outperformed the state of the art, N1-methylpseudouridine (100% mPseudo 37 C), upon the first and second administration (compare data from 6, 27, and 51 hours post administration after first dose and second dose between 100% Ac4c 37 C and 100% mPseudo 37 C). This was likely due to a reduced local inflammatory response with Ac4C, that is not achieved with N1-methlypseudouridine, allowing for higher protein expression. By the third administration, Ac4C and N1-methylpseudouridine appeared to become comparable in efficacy. This may have been due to ramping up of systemic inflammation that reaches a threshold with both nucleotides. FIG. 7 shows the systemic cytokines that were either upregulated or downregulated in response to each of the RNA conditions. It is notable that none of the cytokines tested for by the IDEXX BioAnalytics mouse cytokine 25-plex panel test were significantly affected in response to RNA having 100% Ac4C for cytidine. However, N1-methylpseudouridine showed an increase in IP-10 expression. Therefore, the convergence of protein expression at the third administration may have been due to any number of systemic cytokines not tested for in the panel. Nonetheless, the data demonstrated the capacity of N4-acetylcytidine to prevent undesired innate immune responses and improve the expression of a protein of interest compared to N1-methylpseudouridine.

Figure 8:
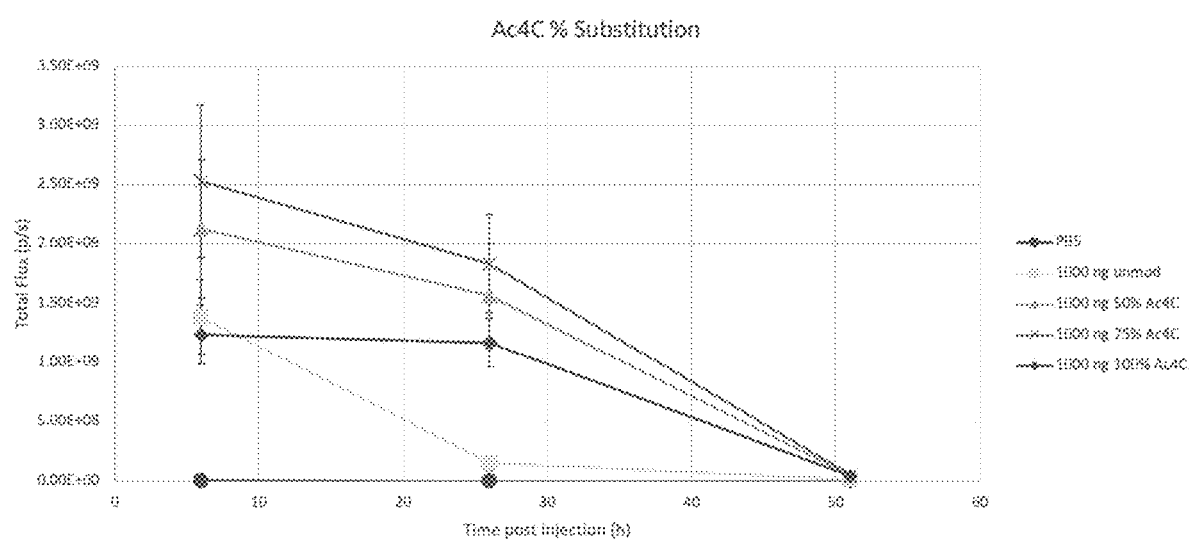
FIG. 8 is a graph showing luciferase expression in BALB/c mice administered 1 microgram of luc2 RNA having the indicated % substitution of n4-acetylcytidine or unmodified luc2 RNA.
Figure 9:
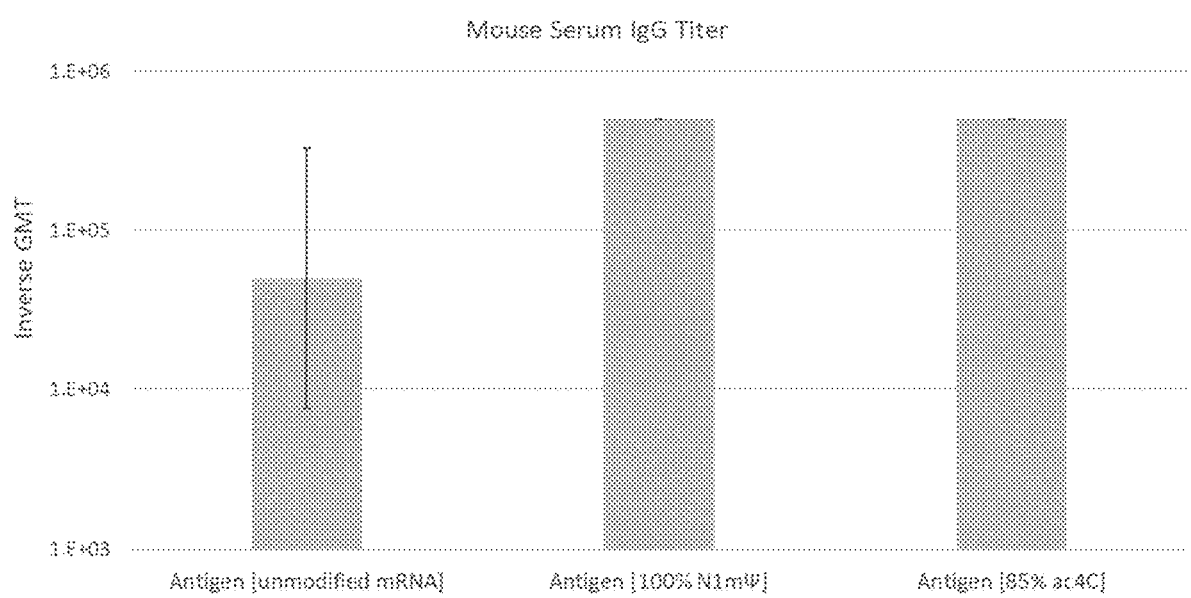
FIG. 9 is a graph showing IgG titers against SARS-CoV-2 RNA vaccine candidates in mice administered the indicated nucleotide compositions.

Comparing the data of FIG. 6 with that of FIG. 8 demonstrates that different benefits were achieved using different percentages of Ac4C. While full substitution allowed improved repeated dosing, the highest absolute expression of Luc2 reporter was achieved with 75% substitution. In addition, FIG. 9 shows that peak IgG titers from the tested SARS-CoV-2 RNA vaccine candidate was achieved with 75% substitution. In some embodiments, this percentage of substitution appearing best for both absolute protein expression and antibody titers could be coincidental as higher titers with 75% substitution may be, e.g., due to a combination of high antigen expression and an adjuvant effect from slightly immunostimulatory RNA. This data showed that there is a clear improvement in RNA efficacy with the use of RNA comprising Ac4C. Based on these findings, the percent Ac4C could be maximized for specific applications by optimizing the percent of Ac4C substitution.

Example 2: Increased Expression of RNA Comprising 5-Hydroxymethyluridine

This Example shows that use of an RNA comprising 5-hydroxymethyluridine (5hmU) in place of natural uridine can reduce undesired immunogenicity that is associated with in vitro transcribed RNAs. The methods used in this example are similar to those described in Example 3 below.

Figure 11:
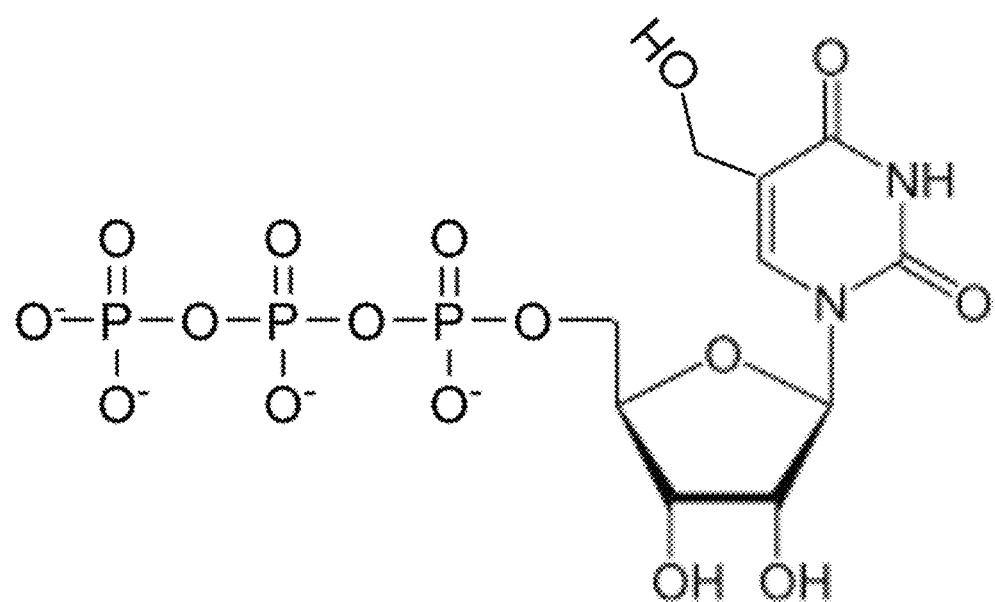
FIG. 11 shows the structure of 5-hydroxymethyluridine triphosphate (5hmU).

To identify other modified ribonucleotides (besides N4-acetylcytidine shown in Example 1) that have improved properties such as reduced immunogenicity and increased expression, a large screen of chemically modified nucleotides was conducted. Based on this screen, one potential candidate that emerged was 5-hydroxymethyluridine (5hmU), shown in FIG. 11.

Figure 12:
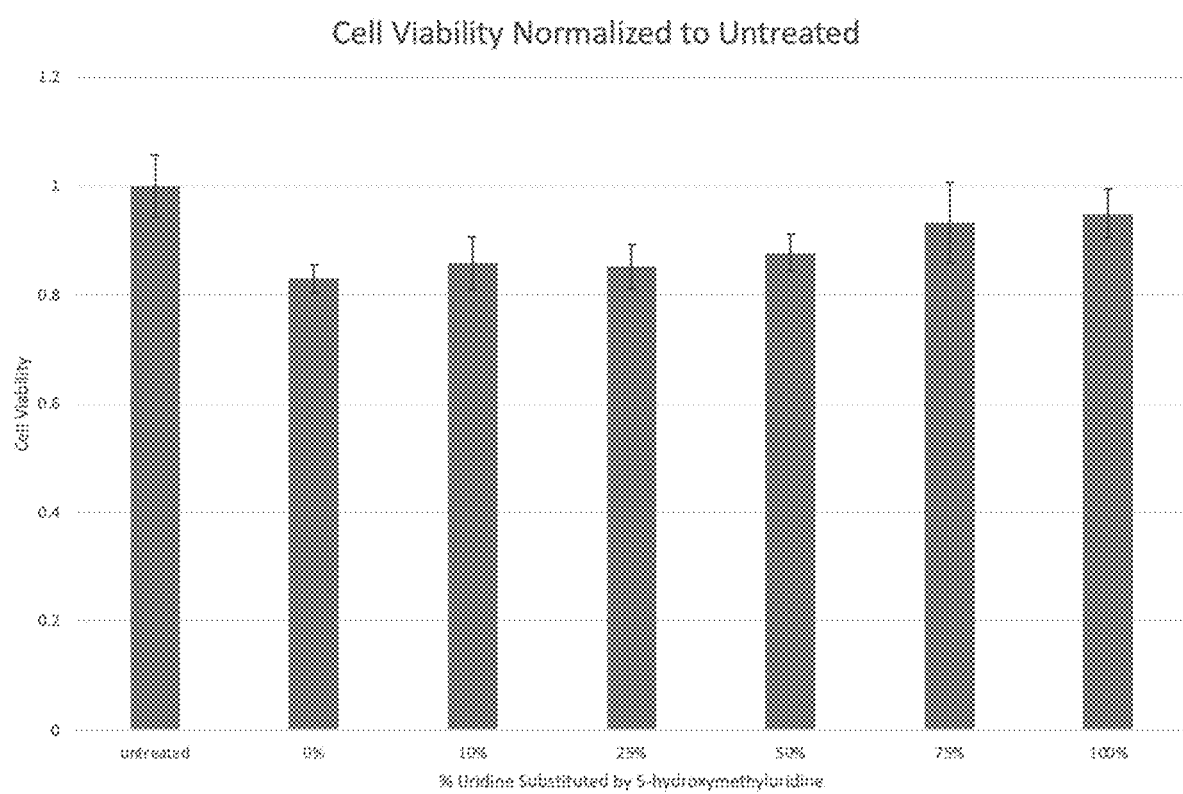
FIG. 12 shows cell viability by RNA synthesized using the indicated percentage of 5-hydroxymethyluridine instead of natural uridine.
Figure 13:
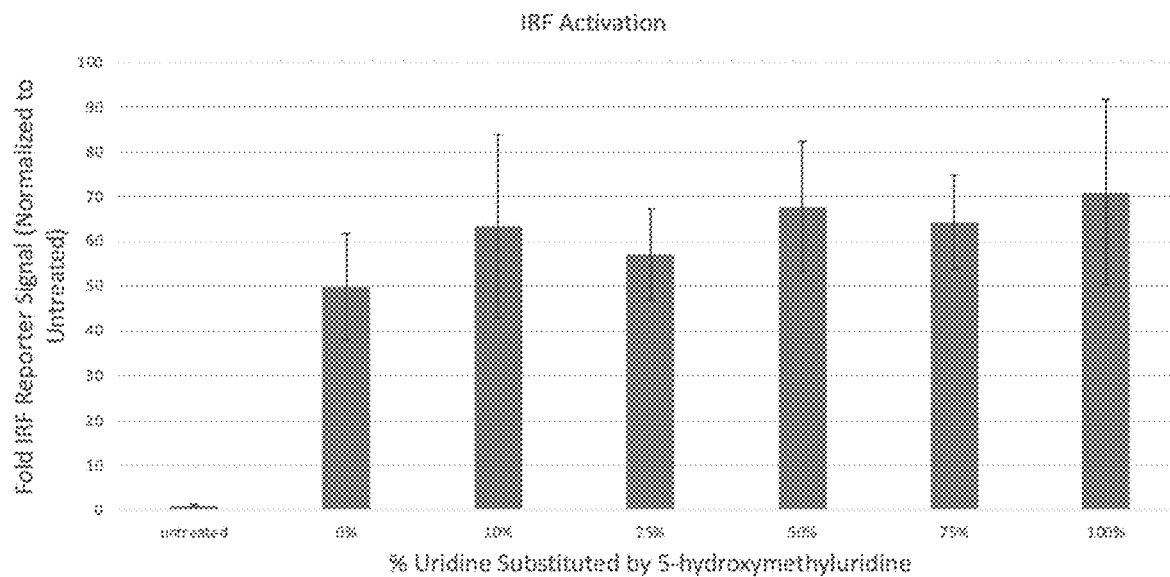
FIG. 13 shows IRF reporter activation by RNA synthesized using the indicated percentage 5-hydroxymethyluridine instead of natural uridine.
Figure 14:
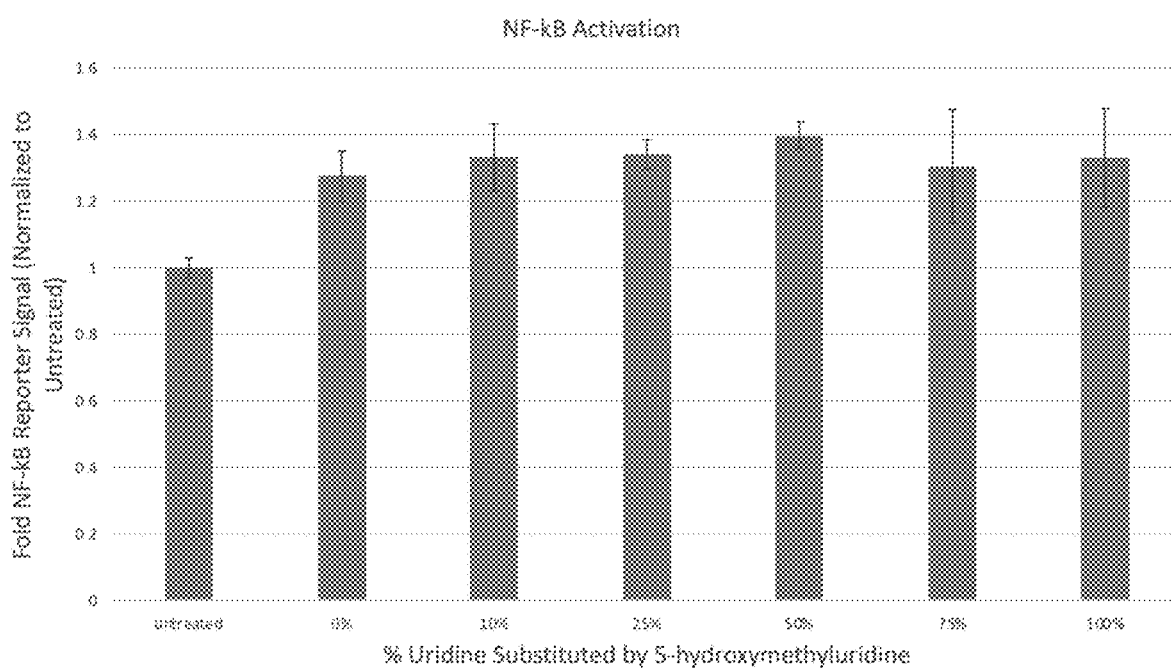
FIG. 14 shows NF-κB reporter activity by RNA synthesized using indicated percentage of 5-hydroxymethyluridine instead of natural uridine.

Messenger RNAs (RNAs) having 0% to 100% substitution of uridines with 5-hydroxymethyluridines were synthesized and the effect of said RNAs on cell viability and immunogenicity were tested. As shown in FIG. 12, RNA having all uridines substituted by 5hmU showed a slight effect on cell viability. FIGS. 13 and 14 demonstrate that RNAs having all uridines substituted by 5hmU had little to no effect on immunogenicity (see FIG. 13 for IRF reporter activation, and FIG. 14 for NF-κB reporter activity).

Figure 15:
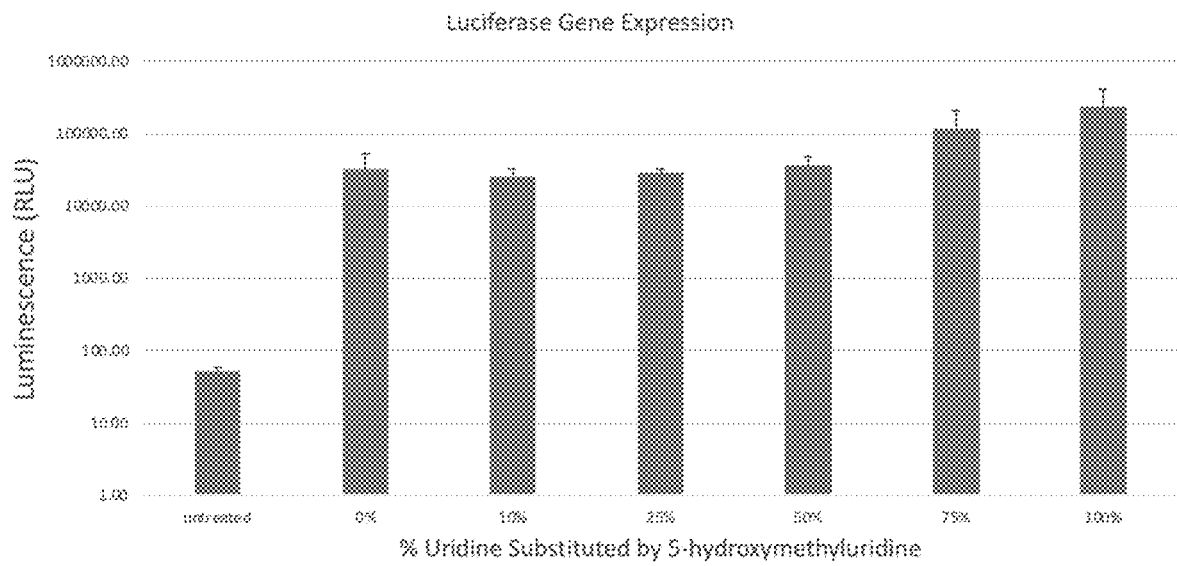
FIG. 15 shows Luciferase gene expression by RNA synthesized using indicated percentage of 5-hydroxymethyluridine instead of natural uridine.

Reporter gene expression using RNAs having uridines substituted by 5hmU (from 0% to 100%) was also tested. As shown in FIGS. 15 and 16, RNAs having a large percentage (e.g., about 75% or more) of uridines substituted with 5hmU showed over 5-fold increase in reporter gene expression as compared to RNAs having a small percentage (less than about 75%) of uridines substituted by 5hmU.

This data demonstrates that RNA comprising 5-hydroxymethyluridines have desirable properties and can be used for therapeutic purposes.

Example 3: Inhibition of Innate Immune Sensing and Improved Expression of RNA Comprising 5-Hydroxymethyluridine and N4-Acetylcytidine This Example shows that use of an RNA comprising both 5-hydroxymethyluridine (5hmU) in place of uridine and N4-acetylcytidine in place of cytidine can reduce undesired immunogenicity that is associated with in vitro transcribed RNAs, reduce detection of uncapped RNAs that are a byproduct of in vitro RNA transcription reactions, and/or increase expression of the RNA or a polypeptide encoded by the RNA. This Example further demonstrates the in vivo expression profile of RNA comprising 5-hydroxymethyluridine and N4-acetylcytidine. As discussed in further detail below, a doubly modified RNA allows for repeated dosing with similar payload expression at each dose.

Methods

IVT Template production: The luc2 gene encoding an optimized version of firefly luciferase was amplified from pGL4.10[luc2] (Promega). Amplification was carried out at an annealing temperature of 70° C. in a 20 µL reaction consisting of 0.25 µM each primer Luc2_fwd and Luc2_rev, 1× Herculase II buffer, 25 mM each dNTP, 30 ng pGL4.10 [luc2] plasmid (Promega), 0.25M Betaine and 0.4 µL Herculase II enzyme. PCR product was purified using a 0.8× ratio of SpriSelect beads (Beckman Coulter) to PCR reaction volume and eluted into 45 µL Nuclease free water. 42.5 uL of the eluted product was subjected to treatment with 125 U of Dpn1 enzyme (New England Biolabs) in a 50 µL reaction to digest template plasmid. The digested product was purified using a 0.65× ratio of SpriSelect beads (Beckman Coulter) to digest reaction volume and eluted into 40 µL nuclease free water. This digested, primary PCR product was then amplified at 50 C in a 20 µL reaction consisting of 0.25 µM each primer T7-AGG_fwd and 120pA_rev, 1x Herculase II buffer, 25 mM each dNTP, 10 ng Luc2 primary amplification product, and 0.4 µL Herculase II enzyme. This secondary PCR product was cleaned up using a 0.8× ratio of SpriSelect beads (Beckman Coulter) to PCR reaction volume and eluted into 10 mM Tris-HCl pH 8.5.

The sequences of primers used were as follows:

```
Luc2_fwd:
                                     (SEQ ID NO: 1)
CTTGTTCTTTTTGCAGAAGCTCAGAATAAACGCTCAACTTTGGCCACCat ggaagatgccaaaaacattaagaagggc Luc2_rev
                                     (SEQ ID NO: 2)
AGAATGTGAA GAAACTTTCT TTTTATTAGG AGCAGATACG

AATGGCTACA TTTTGGGGGA CAACATTTTG TAAAGTGTAA

GTTGGTATTA TGTAGCTTAG AGACTCCATT CGGGTGTTCT

TGAGGCTGGT CTATCATTAc acggcgatct tgccgcc

T7-AGG_fwd
                                     (SEQ ID NO: 3)
gaattTAATA CGACTCACTA TAAGGcttgt tcttttgca gaagc 120pA_rev
                                     (SEQ ID NO: 4)
TTTTTTTTTT TTTTTTTTTT TTTTTTTTTT TTTTTTTTTT

TTTTTTTTTT TTTTTTTTTT TTTTTTTTTT TTTTTTTTTT

TTTTTTTTTT TTTTTTTTTT TTTTTTTTTT TTTTTTTTTT agaatgtgaa gaaactttct ttttattag
```

In vitro transcription (IVT) of Luc2 RNA: Luc2 RNA was synthesized in 20 µL IVT reactions consisting of 200 ng Luc2 T7 template, 20 mM MgCl2, 7.5 mM each NTP, 7.5 mM CleanCap AG (TriLink), 1× HiScribe Transcription Buffer, and 2 uL HiScribe polymerase mix (NEB) and incubated at 37° C. for 1 hour. To test for synergy of N4-acetylcytidine or 5-hydroxymethyluridine, the corresponding percentage of CTP or UTP was replaced with Ac4CTP (Jena BioScience) or 5hmUTP (TriLink) in the IVT mixture. In the gradient of increasing Ac4CTP, 5hmU percentage was held constant at 100%. In the gradient of increasing 5hmU, Ac4C percentage was held constant at 100%. RNA using natural nucleotides was made alongside to act as controls that are representative of highly immunogenic RNA.

All IVT products were cleaned up using Monarch 500 μg RNA Clean Up kit (NEB) and eluted into 88 μL nuclease-free water. Eluted products were then digested in 100 μL reactions consisting of 1× DNase I buffer and 10 U of DNase I (RNase-free) (New England Biolabs) at 37° C. for 10 minutes to degrade DNA template. DNase I treated samples were cleaned up using Monarch 500 ug RNA Clean Up kit (New England Biolabs) and eluted into 88 μL nuclease-free water.

The DNAse I treated products, which have a co-transcriptionally added Cap 1 structure, were treated with 1× DNase I buffer (NEB) and 100 U CIAP (Promega) at 37 C for 5 min as a polishing step to remove rare immunogenic 5' triphosphates from RNA transcripts that did not incorporate CleanCap AG. DNase I buffer was used for this step since using the Promega CIAP in DNAse I buffer from NEB is more effective for RNA 5' end polishing than using the CIAP enzyme in its own buffer.

CIAP treated RNAs were cleaned up using Monarch 500 ug RNA Clean Up kit (NEB) and eluted into nuclease free H2O.

RNA Quantification: RNA concentration was determined using a NanoDrop OneC spectrophotometer (Thermo Scientific).

A549 Cell Culture Methods: A549-Dual (InvivoGen) were cultured in high glucose GlutaMAX Dulbecco's Modified Eagle Medium supplemented with 10% heat-inactivated fetal bovine serum, 100 units/mL penicillin, 100 μg/mL streptomycin, 10 μg/mL blasticidin, and 100 μg/mL zeocin and maintained at 37° C. and 5% $CO_2$.

Cells were plated to a 96-well at 2,000 cells/well 1 day prior to transfection. 50 ng of each RNA were transfected using Lipofectamine MessengerMAX Transfection Reagent (ThermoFisher) using a 1:1.5 μg:μL ratio of RNA:MessengerMAX. Transfections were performed in triplicate.

Viability and luciferase expression were determined using the ONE-Glo+Tox Luciferase Reporter and Cell Viability Assay (Promega). NF-κB activation was measured via the SEAP reporter gene using the QUANTI-Blue detection reagent (InvivoGen) as described by the manufacturer. The IRF pathway activation was measured via the activity of Lucia luciferase gene using QUANTI-Luc detection reagent (InvivoGen) as described by the manufacturer.

RNA-LNP Formulations: Formulations of RNA in lipid nanoparticles (RNA-LNPs) were prepared using an Ignite microfluidic mixer (Precision Nanosystems, Vancouver, BC). Briefly, GenVoy-ILM lipid mixture (Precision Nanosystems NWW0042) was diluted to 12.5 mM in anhydrous ethanol, and combined with an aqueous solution of RNA (0.14 mg/mL) in PNI buffer (Precision Nanosystems NWW0043), using the manufacturer-recommended formulation parameters. Formulations were immediately diluted 30:1 in phosphate-buffered saline (Gibco 10010023), concentrated using Amicon centrifugation filters (MilliporeSigma UFC901008), and adjusted to an estimated final volume with PBS. Next, formulations where characterized on a Stunner UV-VIS/DLS instrument (Unchained Labs) then further diluted with PBS as necessary to a precise payload concentration (ug/mL). Formulations were stored at 4° C. until in vivo administration.

Single and Repeat dose Luc2 RNA administration studies in mice: Animal experiments were carried out in accordance with the guidelines set forth by Charles River Accelerator Development Lab (CRADL, Cambridge, Mass., USA) and were approved by the CRADL Institutional Animal Care and Use (IACUC) committee. Female BALB/C mice (7-9 weeks old) were purchased from Charles River Laboratories (Wilmington, Mass., USA) and housed at CRADL. Mice (n=5 per condition) were acclimated for at least 2 days before the initiation of the study. For the single administration study (FIG. 8), animals received one IV RNA-LNP administration. During the course of repeat dose studies, animals received three IV RNA administrations at 72 hour intervals. In either case, mice were imaged via whole body bioluminescence imaging at three time points following each RNA administration (~6 hours, —24 hours and ~48 hours post administration). All RNA injections consisted of 200 uL RNA-LNP formulation (1-9 ug Luc2 RNA dose per animal) delivered via tail vein injection. For whole body bioluminescence imaging, animals were injected with 200 uL of D-luciferin K+ salt (PerkinElmer 122799) diluted to 15 mg/mL in PBS, via intraperitoneal (IP) injection, 10 minutes prior to the imaging time point. Three minutes prior to imaging, mice were placed under 3% isoflurane anesthesia in an induction chamber, then moved to isoflurane-delivering nosecones in the imaging chamber (IVIS-Spectrum Model 124262; Perkin Elmer, Waltham, Mass.) immediately prior to imaging. Mice were positioned ventral side up in the imaging chamber, and were maintained on 3% isoflurane throughout imaging. Images were acquired using field of view D and continued to be exposed until 30,000 photons were collected or 1 min has passed, whichever occurred first. After imaging, animals were returned to their home cage for recovery.

Figure 49:
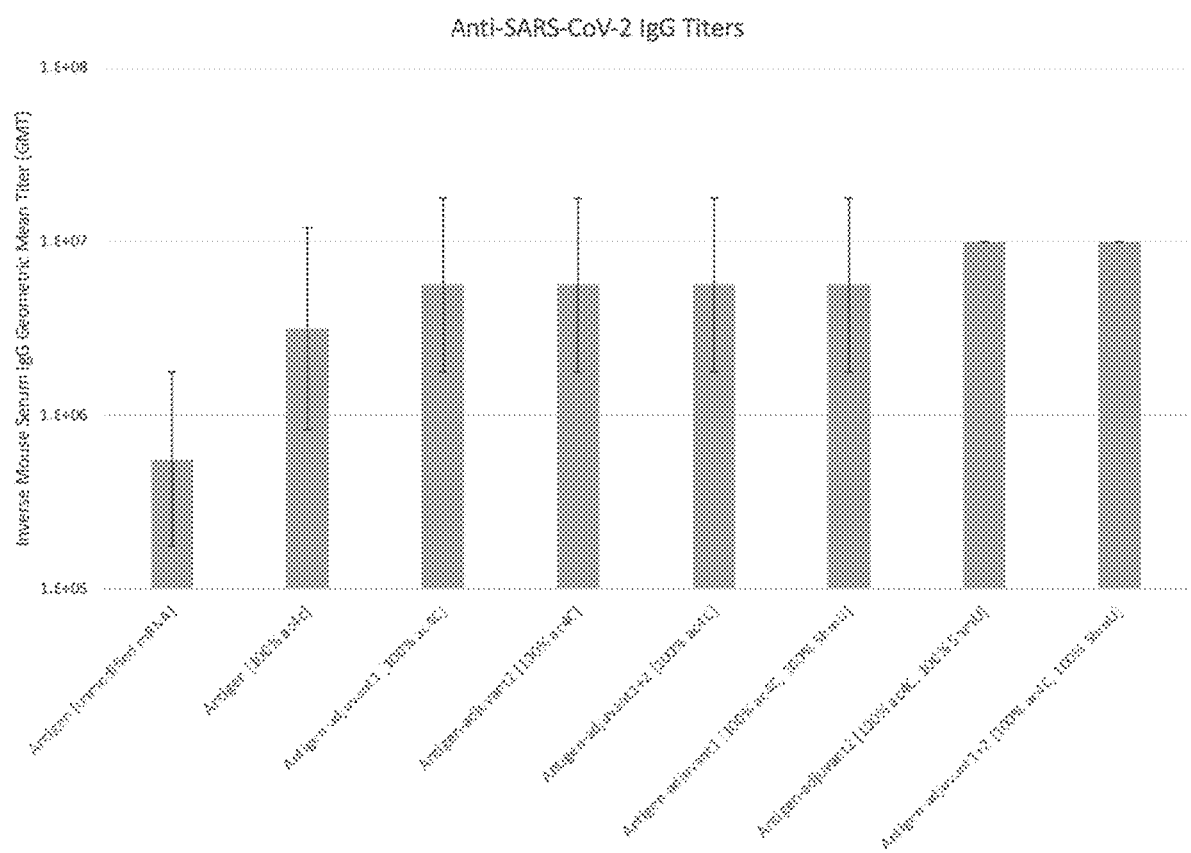
FIG. 49 shows IgG titer in response to vaccination with indicated RNA encoding SARS-CoV-2 vaccine candidate.

Blood Collection & Analysis: Mice were euthanized 72 hours following the third RNA administration, at which time blood was collected via intracardiac stick (FIG. 7). Alternatively, a second set of cages (in addition to IVIS imaged mice) were euthanized 6 hours following RNA administration (after a single 9 ug dose, a single 1 ug dose, or three 1 ug doses administered 72 hours apart), at which time blood was collected via intracardiac stick (FIG. 49). Serum was separated from blood in MiniCollect serum separator tubes (Greiner Bio-One 450472) by centrifugation at 4° C., 1200× g, for 10 minutes. Aliquots of serum were frozen at −80° C. and shipped on dry ice to IDEXX BioAnalytics for a mouse cytokine 25-plex panel test (Columbia, Mo. site; test code 62579).

RNA Vaccine Immunogenicity Screening in Mice: All animal experiments were carried out in accordance with the guidelines set forth by Charles River Accelerator Development Lab (CRADL, Cambridge, Mass., USA) and were approved by the CRADL Institutional Animal Care and Use (IACUC) committee. Female BALB/C mice (7-9 weeks old) were purchased from Charles River Laboratories (Wilmington, Mass., USA) and housed at CRADL. Mice (n=4 per condition) were acclimated for at least 2 days before the initiation of a study. On Day 0, mice were injected in the right quadriceps with a prime formulation of 50 uL RNA-LNP (10 ug RNA dose per animal). On Day 7 (FIG. 9) or Day 21 (FIG. 50), mice were injected in the left quadriceps with a boost formulation of 50 uL of the same RNA-LNP formulation used for prime administration (again 10 ug dose per animal). On Day 14 (FIG. 9) or Day 35 (FIG. 50), mice were euthanized, at which time blood was collected via intracardiac stick. Serum was separated from blood in MiniCollect serum separator tubes (Greiner Bio-One 450472) by centrifugation at 4° C., 1200×g, for 10 minutes. Fresh serum was stored at 4° C. and used to evaluate immunogenicity by ELISA.

Serum antibody titers: Total IgG antigen-specific antibodies was determined by enzyme-linked immunosorbent assay (ELISA). Briefly, serum was serially diluted 1:10. Plates (Thermo Scientific Nunc 442404) were coated with Sars- CoV-2 spike protein (Sino Biological 40589-VO8B1) at 2 ug/mL in PBS overnight at 4° C. Plates were washed three times with 0.1% Tween 20 in PBS, then blocked with SuperBlock PBS Blocking Buffer (Thermo Scientific 37515) for 1 hour at room temperature. Plates were then incubated with diluted serums for 2 hours at room temperature, then washed three times with 0.1% Tween 20 in PBS. Plates were then incubated with a Goat-anti-mouse IgG HRP-conjugated secondary antibody (Millipore Sigma AP127P) for 1 hour at room temperature, then washed three times with 0.1% Tween 20 in PBS. Finally, plates were developed with SigmaFast OPD reagent (P(187) for 10 minutes at room temperature, and stopped with 3N HCL and absorbance was read a 490 nm on a Promega Discovery plate reader.

Results:

Given the effects of N4-acetylcytidine (ac4C) for reducing immunogenicity and improving cell viability, RNA having gradients of either ac4C or 5-hydromethyluridine (5hmU) were tested, in the context of full substitution of the non-gradient nucleotide, to determine if there was a synergy between the two modified nucleotides. It was hypothesized that the multi-fold increase in expression from 100% 5hmU (as shown in Example 2 and data therein) could make up for the decrease in protein expression observed with 100% ac4C (see Example 1 and data therein), while maintaining the low immunogenicity benefits that come with 100% ac4C substitution.

Figure 17:
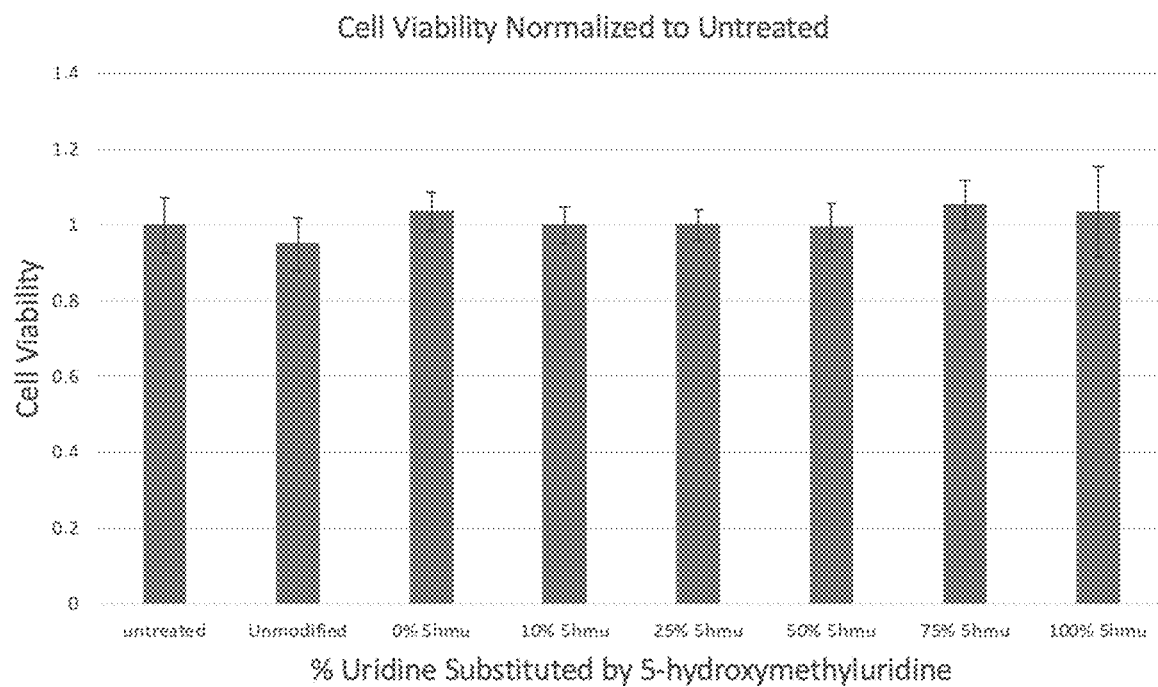
FIG. 17 shows cell viability by RNA synthesized using indicated percentage of 5-hydroxymethyluridine instead of natural uridine in combination with 100% Ac4C for cytidine at a dose of 50 ng.
Figure 18:
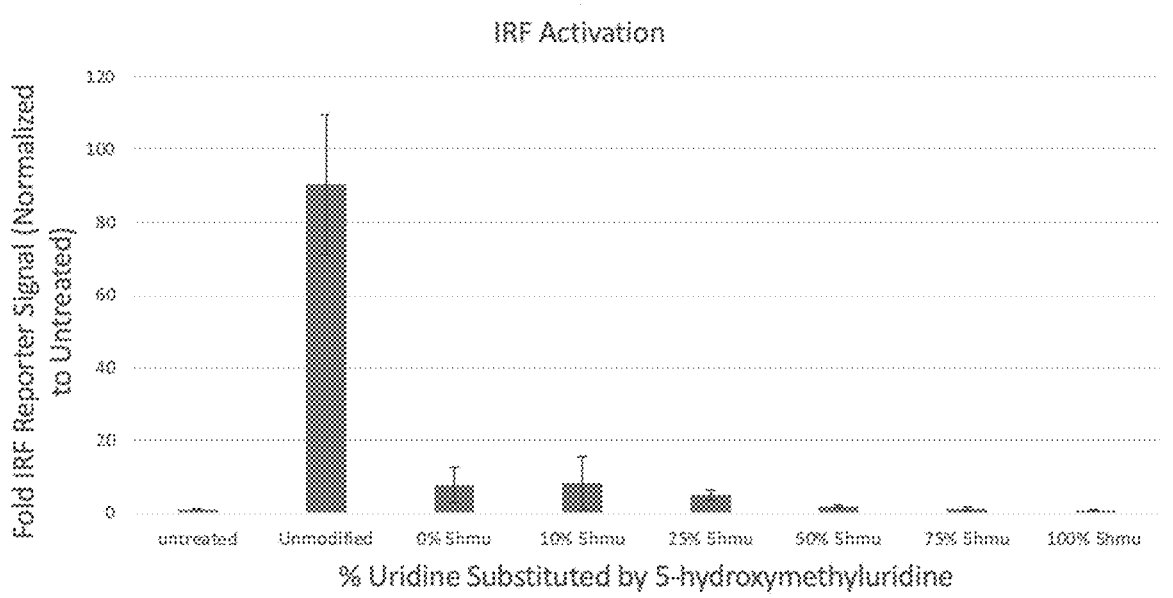
FIG. 18 shows IRF reporter activation by RNA synthesized using indicated percentage 5-hydroxymethyluridine instead of natural uridine in combination with 100% Ac4C for cytidine at dose of 50 ng.
Figure 19:
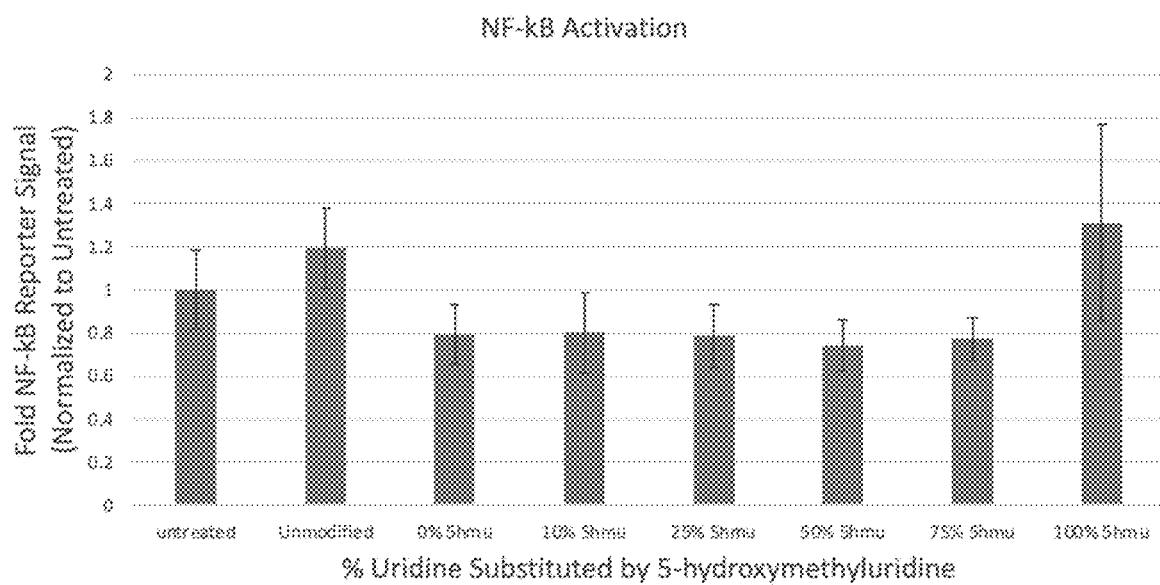
FIG. 19 shows NF-κB reporter activation by RNA synthesized using indicated percentage 5-hydroxymethyluridine instead of natural uridine in combination with 100% Ac4C for cytidine at a dose of 50 ng.
Figure 20:
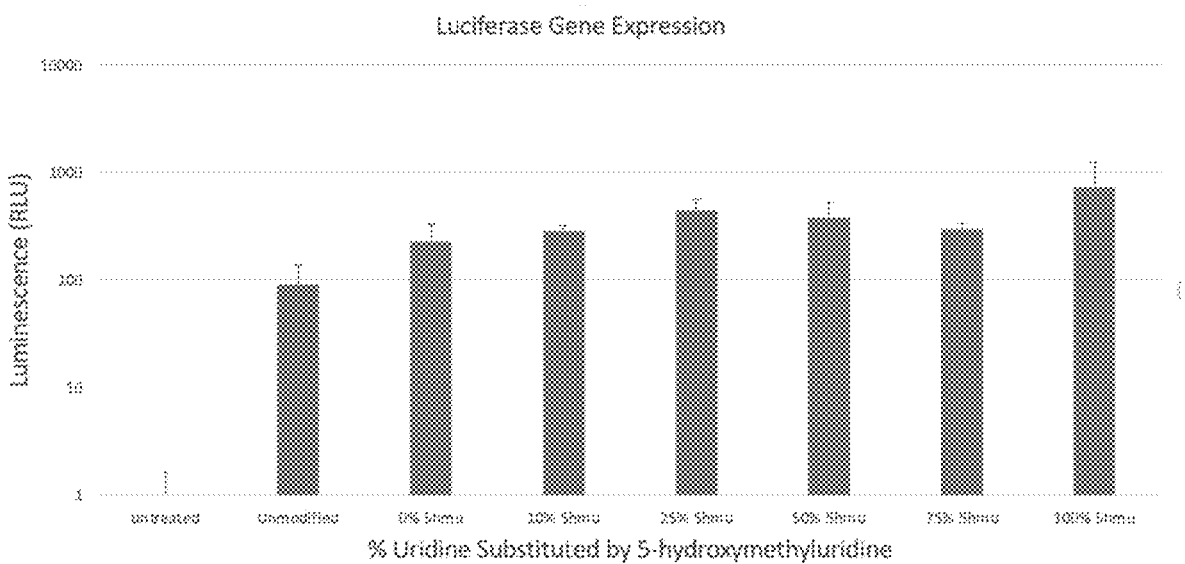
FIG. 20 shows Luciferase gene expression normalized to untreated by RNA synthesized using indicated percentage of 5-hydroxymethyluridine instead of natural uridine in combination with 100% Ac4C for cytidine at a dose of 50 ng.
Figure 21:
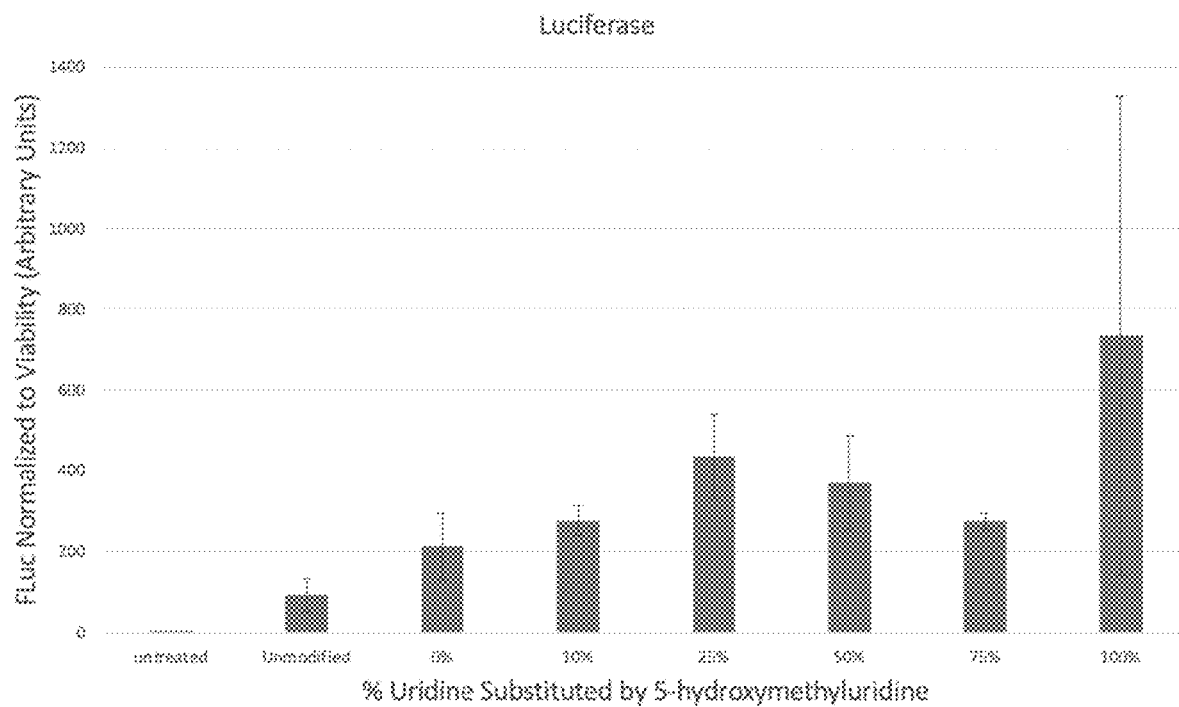
FIG. 21 shows Luciferase gene expression normalized to cell viability by RNA synthesized using indicated percentage 5-hydroxymethyluridine instead of natural uridine in combination with 100% Ac4C for cytidine at a dose of 50 ng.
Figure 22:
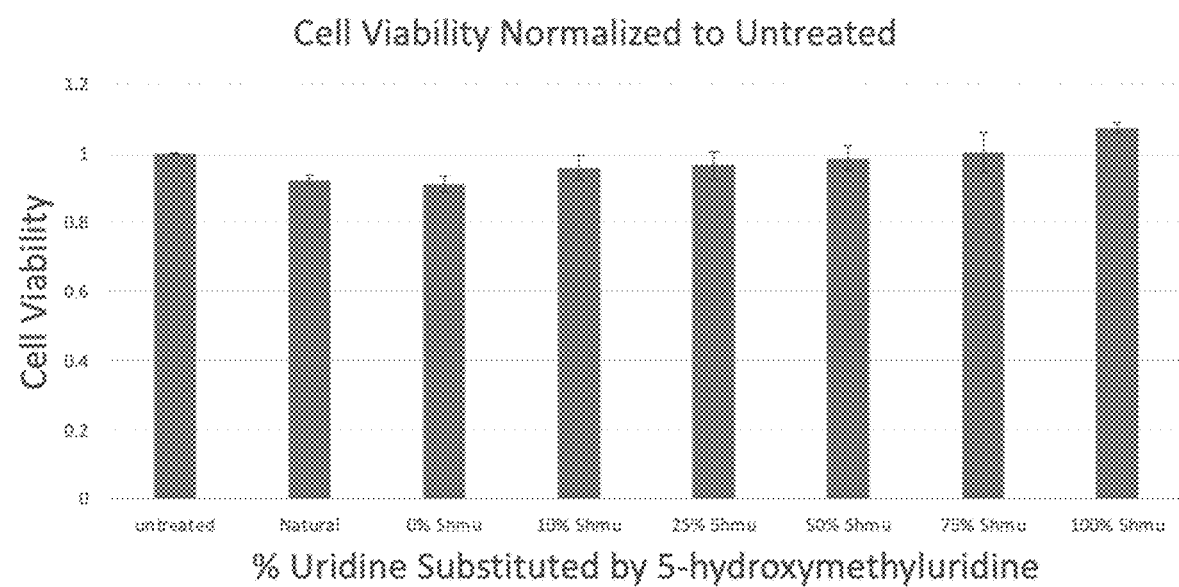
FIG. 22 shows Cell Viability by RNA synthesized using indicated percentage of 5-hydroxymethyluridine instead of natural uridine in combination with 100% Ac4C for cytidine at a dose of 200 ng.
Figure 23:
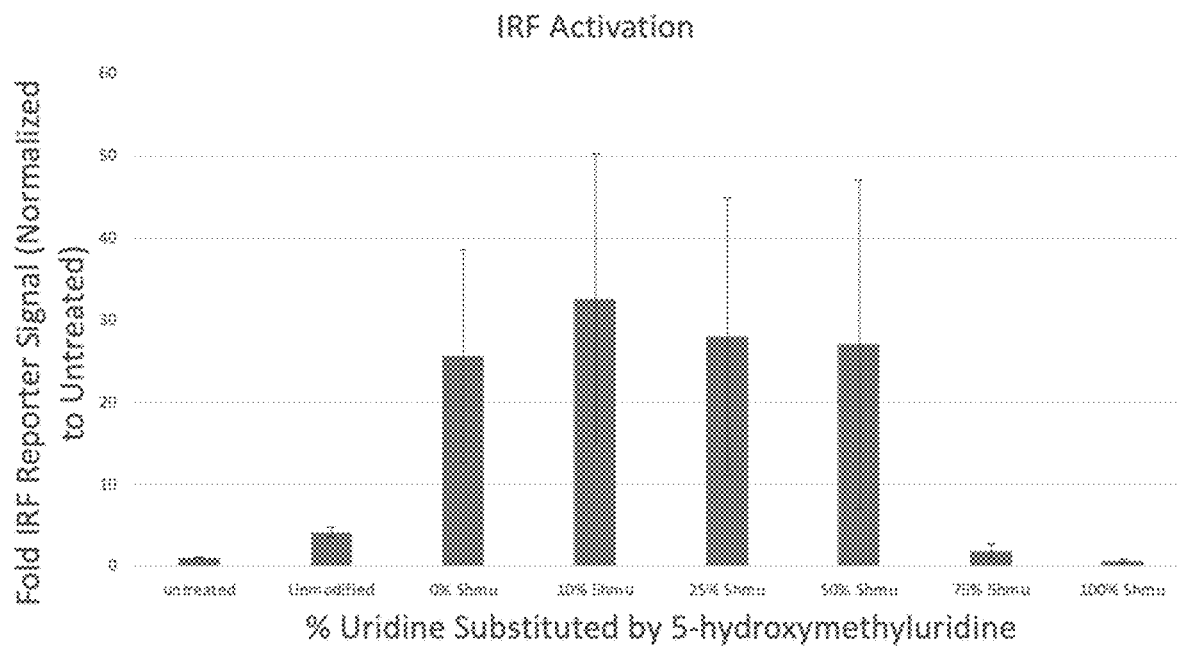
FIG. 23 shows IRF reporter activation by RNA synthesized using indicated percentage 5-hydroxymethyluridine instead of natural uridine in combination with 100% Ac4C for cytidine at a dose of 200 ng.
Figure 24:
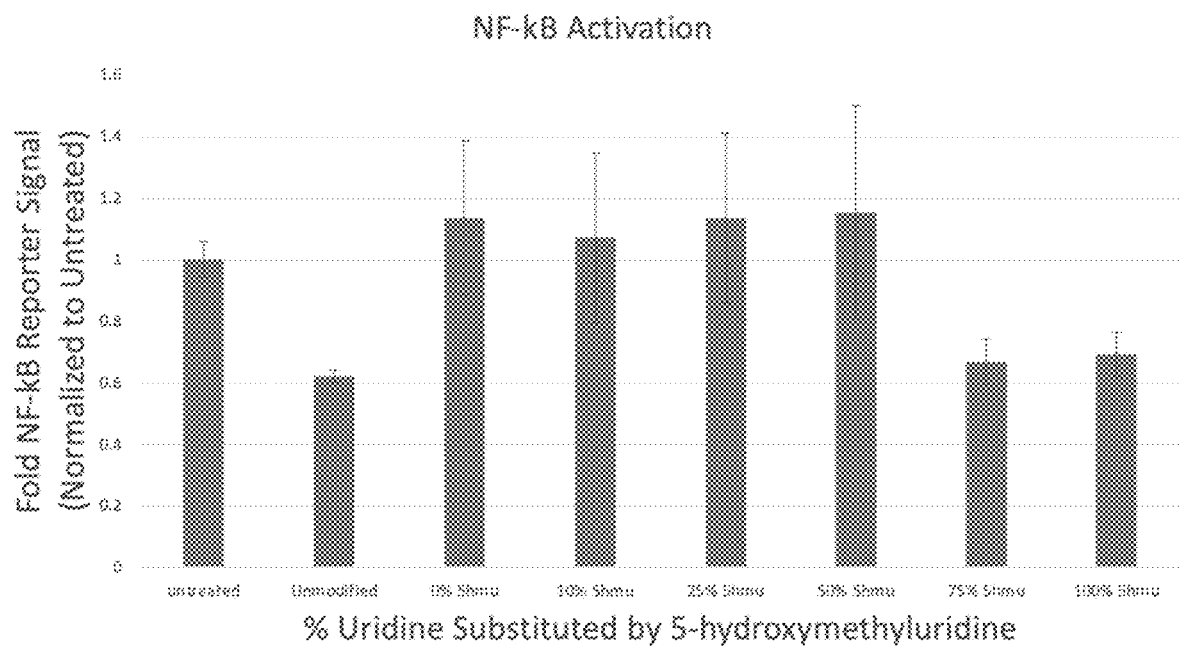
FIG. 24 shows NF-κB reporter activation by RNA synthesized using indicated percentage 5-hydroxymethyluridine instead of natural uridine in combination with 100% Ac4C for cytidine at a dose of 200 ng.
Figure 25:
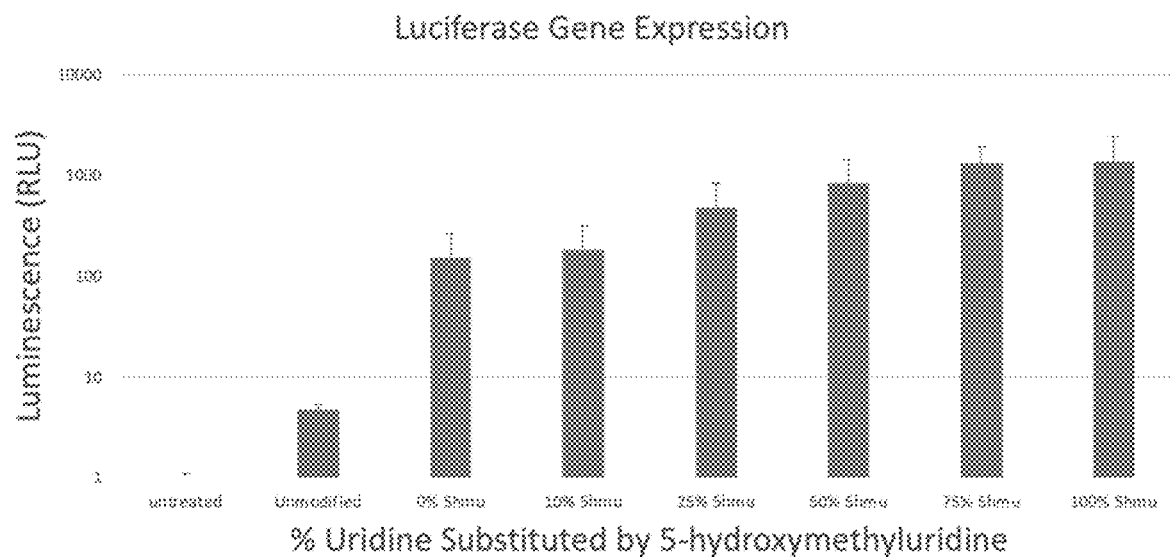
FIG. 25 shows Luciferase gene expression normalized to untreated by RNA synthesized using indicated percentage of 5-hydroxymethyluridine instead of natural uridine in combination with 100% Ac4C for cytidine at a dose of 200 ng.
Figure 26:
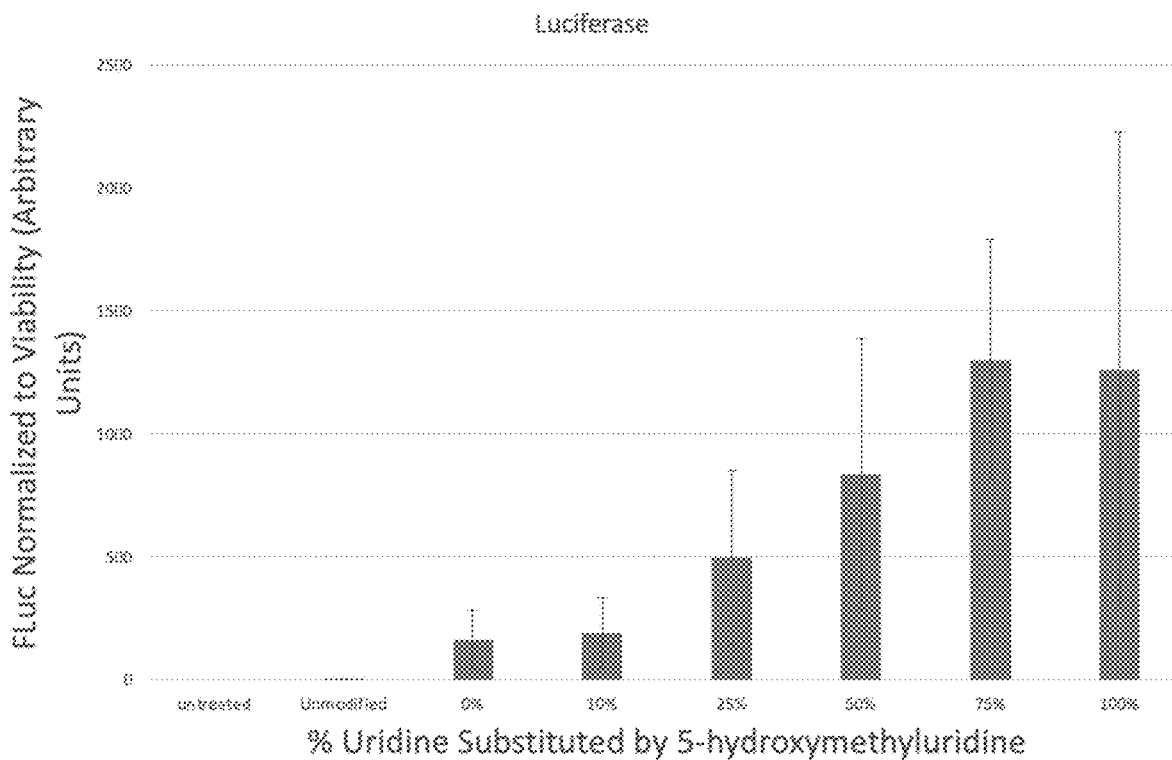
FIG. 26 shows Luciferase gene expression normalized to cell viability by RNA synthesized using indicated percentage 5-hydroxymethyluridine instead of natural uridine in combination with 100% Ac4C for cytidine at a dose of 200 ng.

FIGS. 17-21 show the effect of increasing 5hmU percentage at an RNA dose of 50 ng while FIGS. 22-26 use the same samples but at a higher dose of 200 ng. In these samples, except for the unmodified control, natural cytidine was fully substituted with ac4C. The effect of RNAs having fully substituted ac4C with varying degrees of 5hmU substitution on cell viability is shown in FIG. 17 (50 ng) and FIG. 22 (200 ng). The inhibition of IRF activation with RNAs having fully substituted ac4C with varying degrees of 5hmU substitution is shown in FIG. 18 (50 ng) and FIG. 23 (200 ng). The inhibition of NF-κB activation with RNAs having fully substituted ac4C with varying degrees of 5hmU substitution is shown in FIG. 19 (50 ng) and FIG. 24 (200 ng). Reporter gene expression with RNAs having fully substituted ac4C with varying degrees of 5hmU substitution is shown in FIGS. 20-21 (50 ng) and FIGS. 25-26 (200 ng). As shown in FIGS. 20-21 and FIGS. 25-26, enhanced luciferase expression was observed with RNAs having fully substituted ac4C with varying degrees of 5hmU substitution.

FIGS. 27-36 show the data of the follow up experiment in which 50 ng (FIGS. 27-31) and 200 ng (FIGS. 32-36) doses of RNA samples that had all uridines substituted by 5hmU and with a variable substitution percentage of ac4C were tested.

Figure 27:
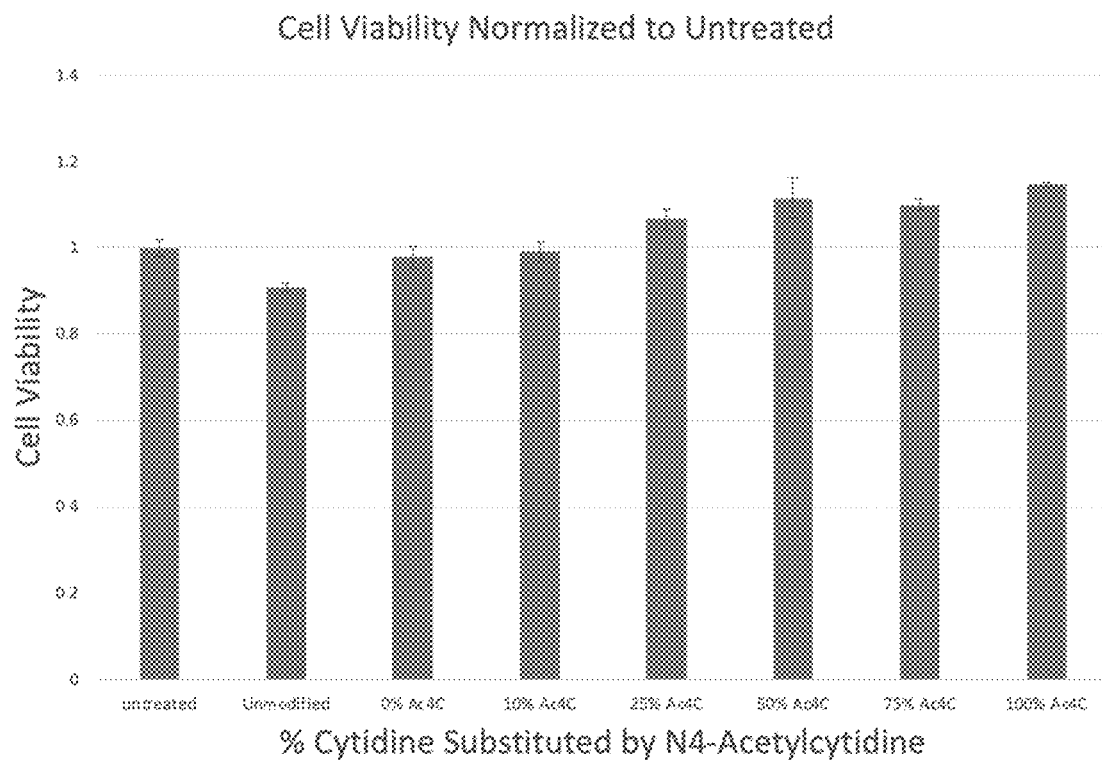
FIG. 27 shows Cell Viability by RNA synthesized using indicated percentage of N4-Acetylcytidine instead of natural cytidine in combination with 100% 5hmu for uridine at a dose of 50 ng.
Figure 28:
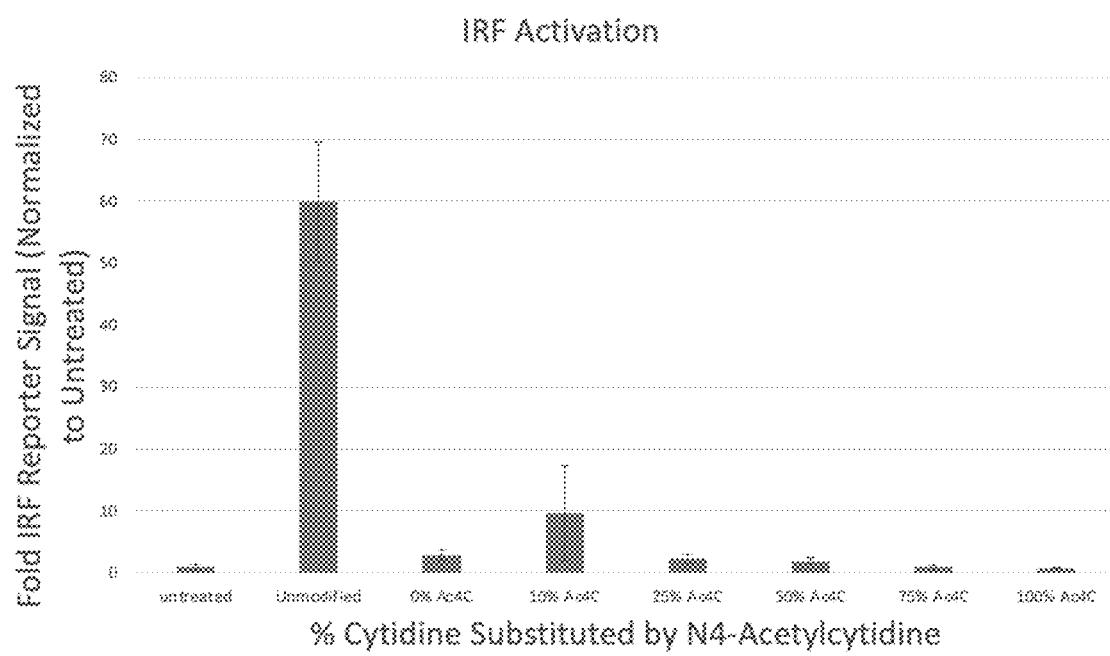
FIG. 28 shows IRF Reporter activation by RNA synthesized using indicated percentage of N4-Acetylcytidine instead of natural cytidine in combination with 100% 5hmu for uridine at a dose of 50 ng.
Figure 29:
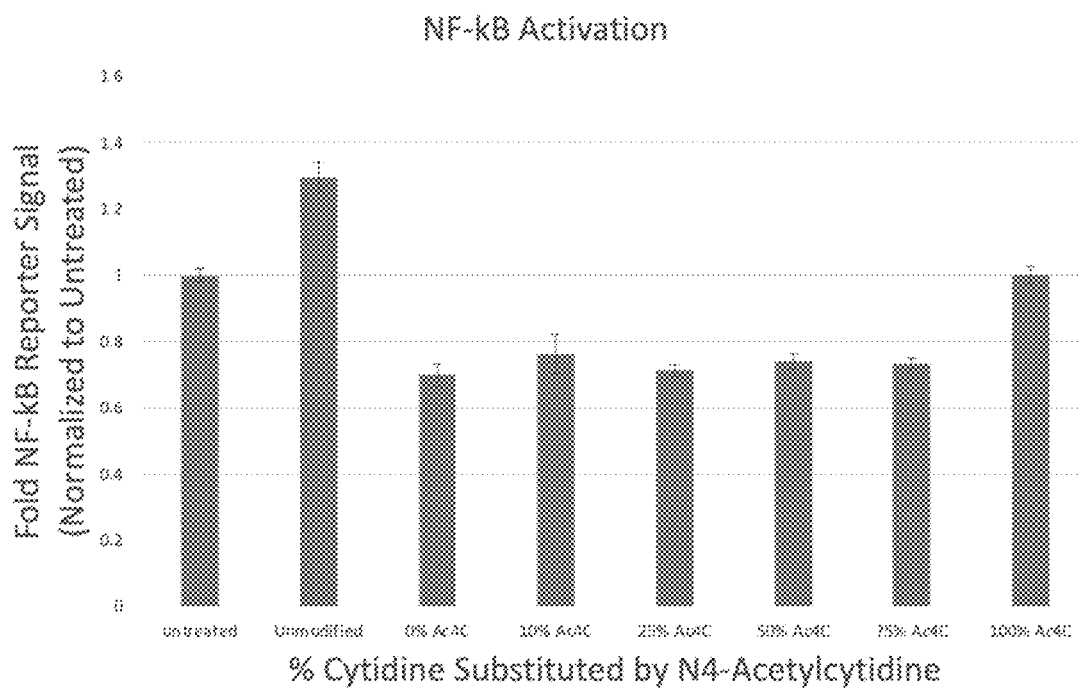
FIG. 29 shows NF-κB Reporter activation by RNA synthesized using indicated percentage of N4-Acetylcytidine instead of natural cytidine in combination with 100% 5hmu for uridine at a dose of 50 ng.
Figure 30:
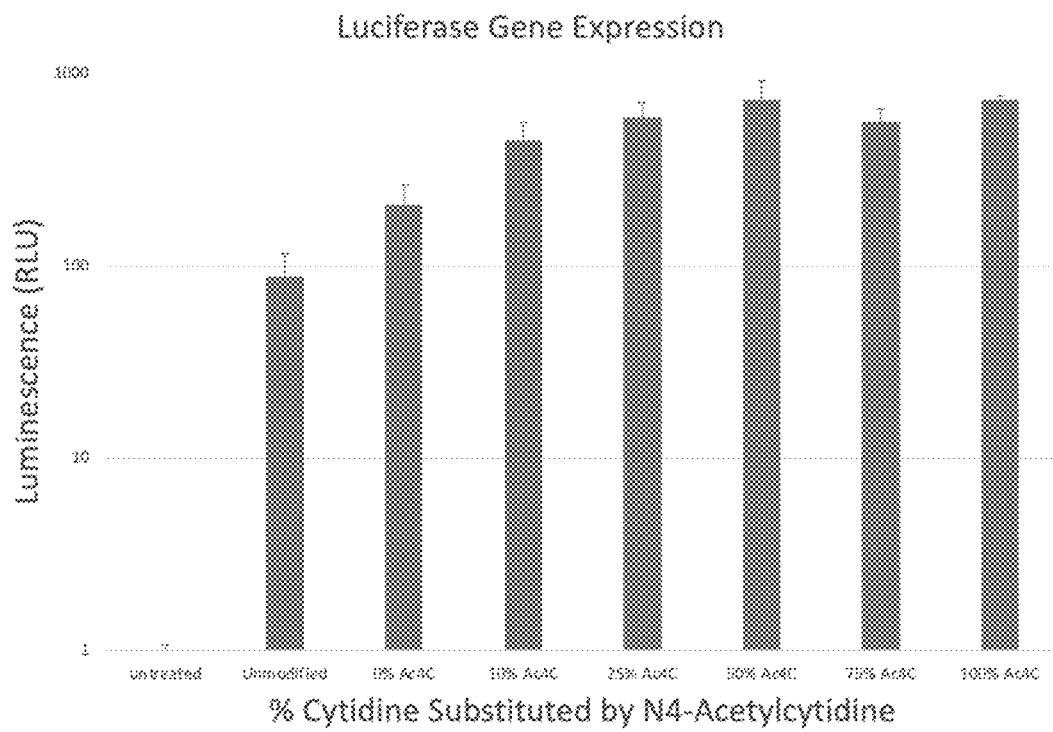
FIG. 30 shows Luciferase gene expression normalized to untreated by RNA synthesized using indicated percentage of N4-acetylcytidine instead of natural cytidine in combination with 100% 5hmU for uridine at a dose of 50 ng.
Figure 31:
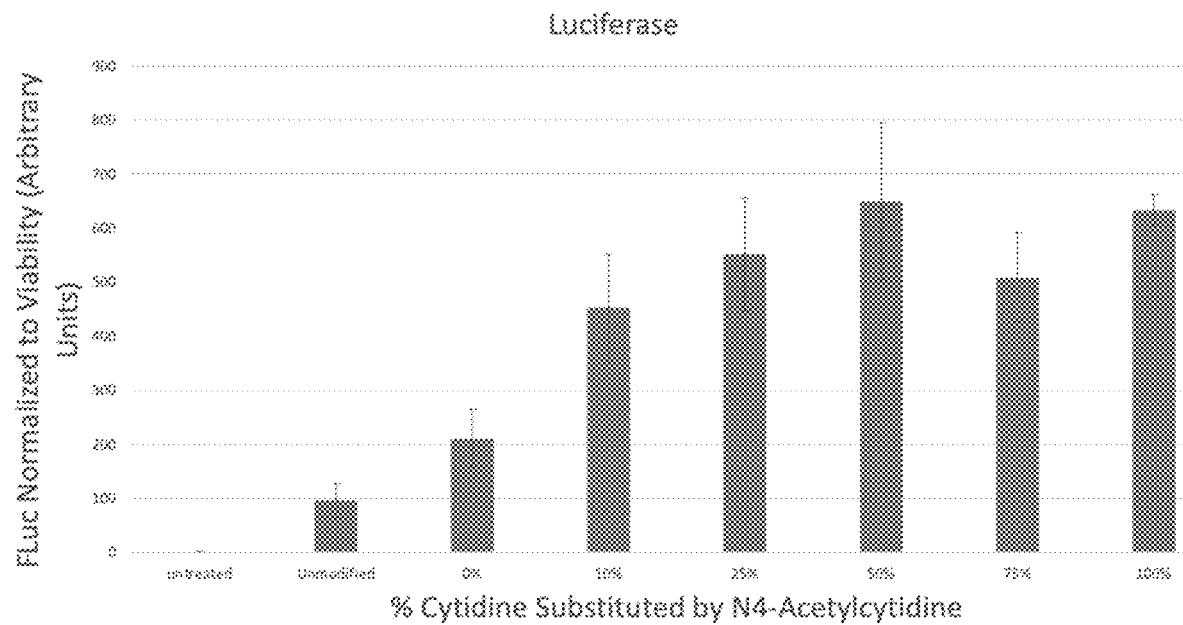
FIG. 31 shows Luciferase gene expression normalized to cell viability by RNA synthesized using indicated percentage N4-acetylcytidine instead of natural cytidine in combination with 100% 5hmu for uridine at a dose of 50 ng.
Figure 32:
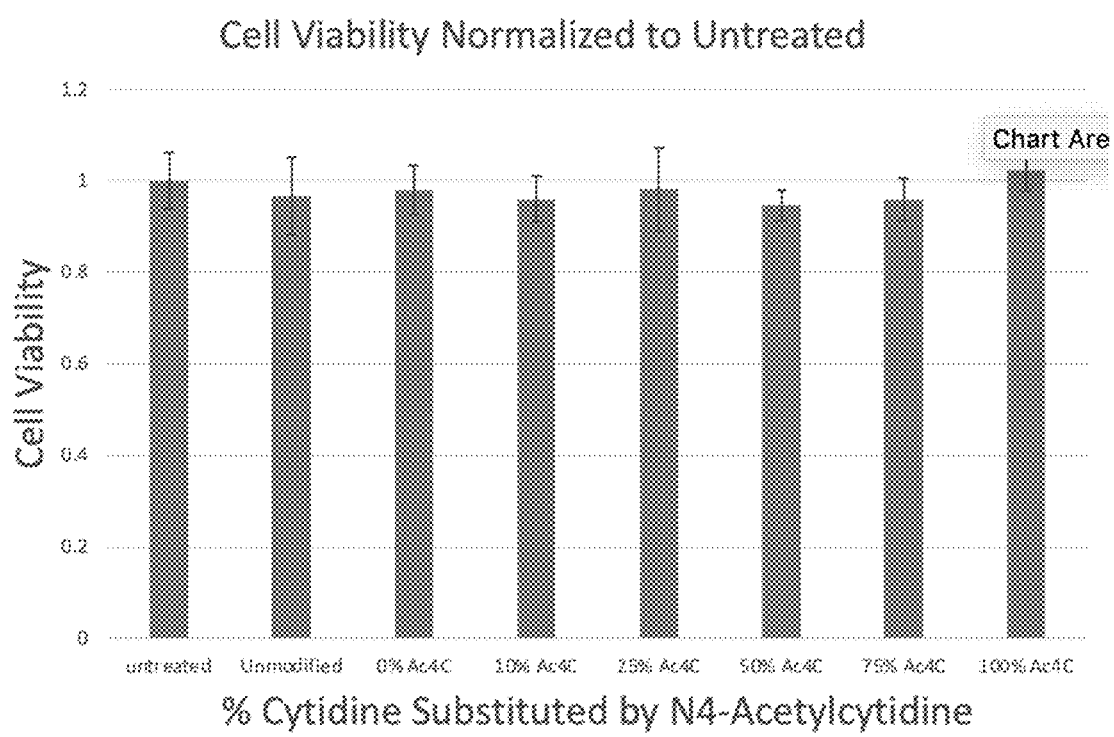
FIG. 32 shows Cell Viability by RNA synthesized using indicated percentage of N4-Acetylcytidine instead of natural cytidine in combination with 100% 5hmu for uridine at a dose of 200 ng.
Figure 33:
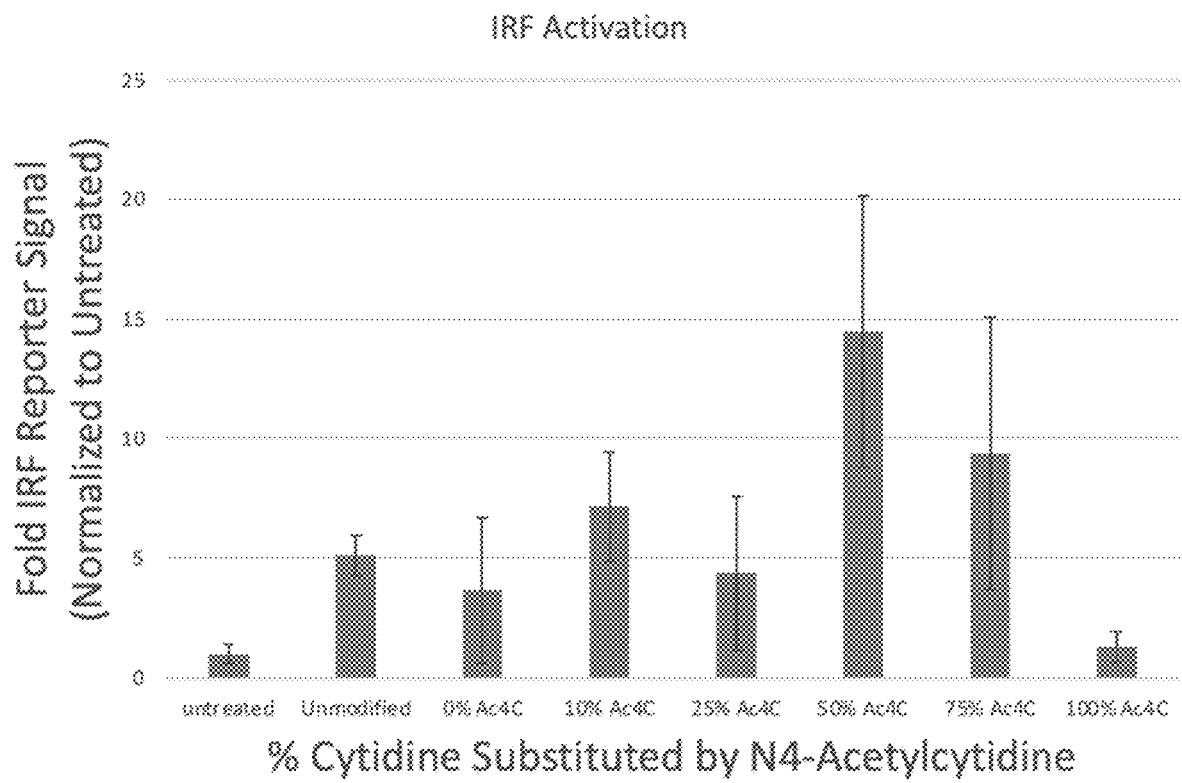
FIG. 33 shows IRF Reporter activation by RNA synthesized using indicated percentage of N4-Acetylcytidine instead of natural cytidine in combination with 100% 5hmu for uridine at a dose of 200 ng.
Figure 34:
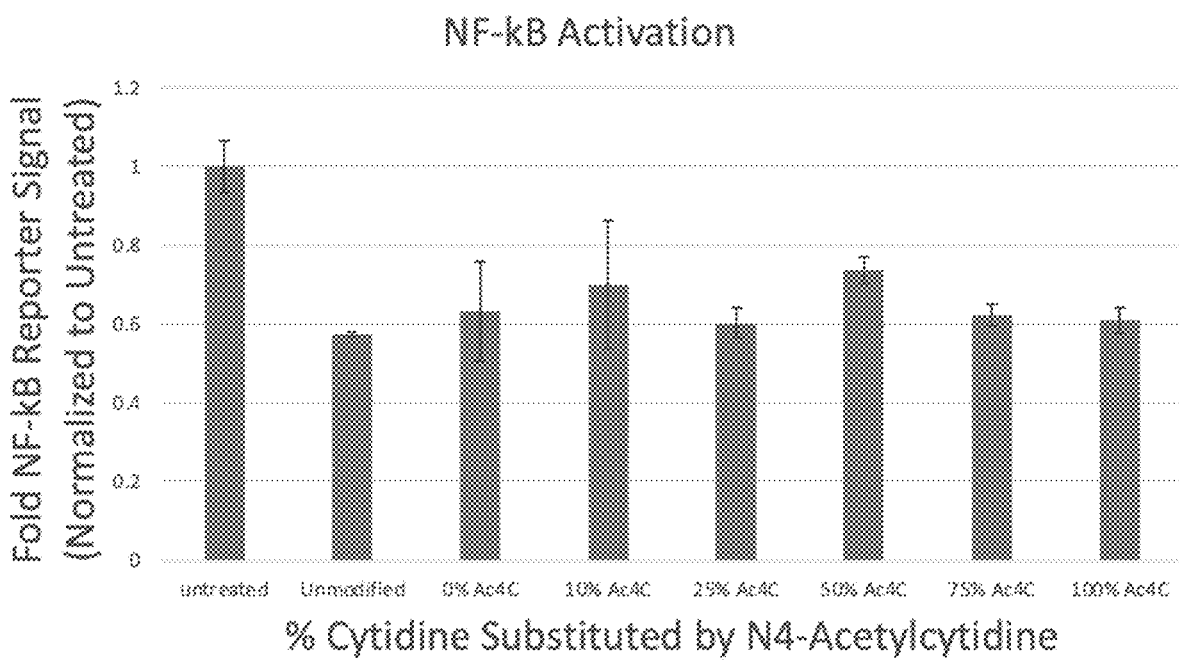
FIG. 34 shows NF-κB Reporter activation by RNA synthesized using indicated percentage of N4-Acetylcytidine instead of natural cytidine in combination with 100% 5hmu for uridine at a dose of 200 ng.
Figure 35:
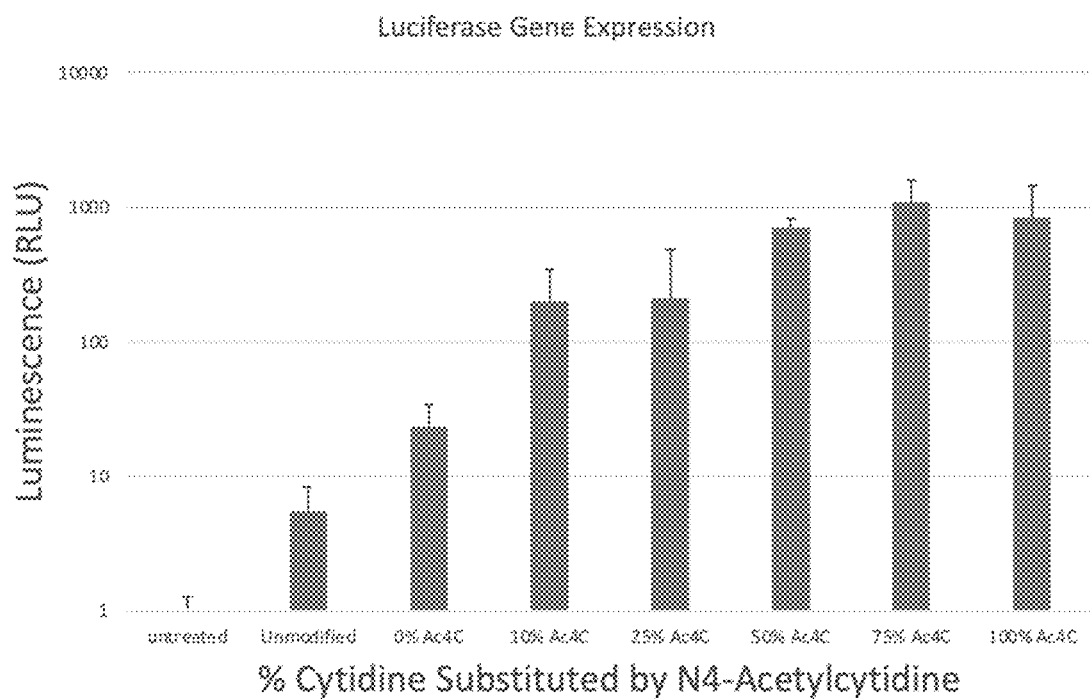
FIG. 35 shows Luciferase gene expression normalized to untreated by RNA synthesized using indicated percentage of N4-acetylcytidine instead of natural cytidine in combination with 100% 5hmu for uridine at a dose of 200 ng.
Figure 36:
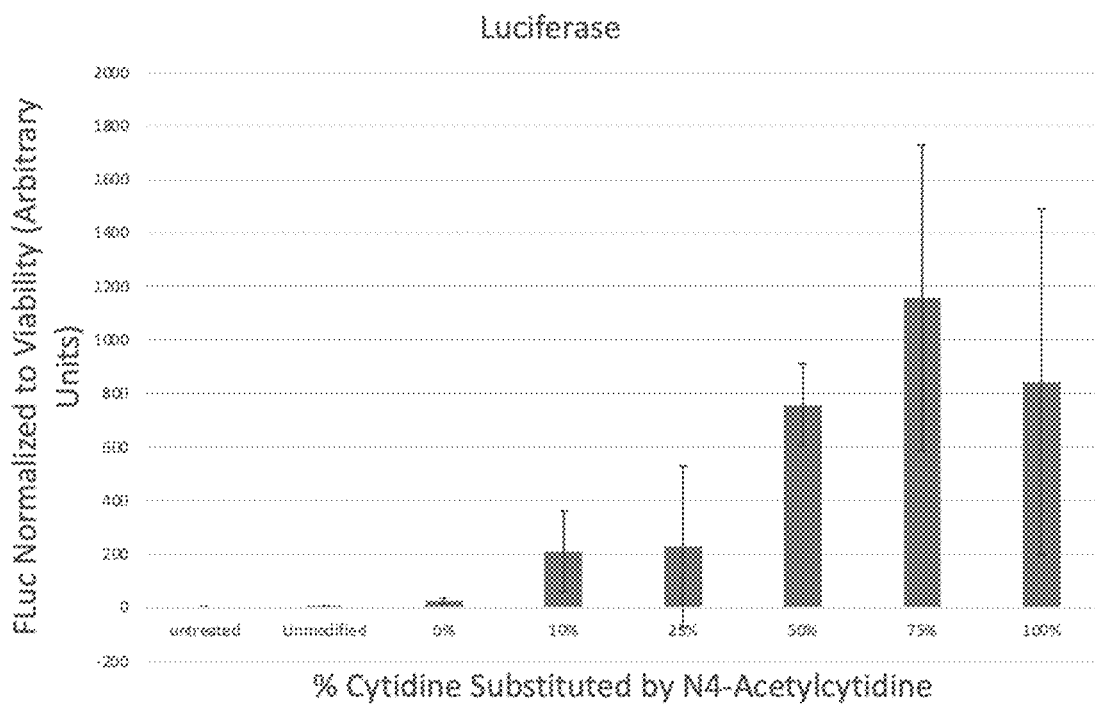
FIG. 36 shows Luciferase gene expression normalized to cell viability by RNA synthesized using indicated percentage N4-acetylcytidine instead of natural cytidine in combination with 100% 5hmu for uridine at a dose of 200 ng.

The effect of RNAs having fully substituted 5hmU with varying degrees of ac4C substitution on cell viability is shown in FIG. 27 (50 ng) and FIG. 32 (200 ng). The inhibition of IRF activation with RNAs having fully substituted 5hmU with varying degrees of ac4C substitution is shown in FIG. 28 (50 ng) and FIG. 33 (200 ng). The inhibition of NF-κB activation with RNAs having fully substituted 5hmU with varying degrees of ac4C substitution is shown in FIG. 29 (50 ng) and FIG. 34 (200 ng). Reporter gene expression with RNAs having fully substituted 5hmU with varying degrees of ac4C substitution is shown in FIGS. 30-31 (50 ng) and FIGS. 35-36 (200 ng). As shown in FIGS. 30-31 and FIGS. 35-36, enhanced luciferase expression was observed with RNAs having fully substituted 5hmU with varying degrees of ac4C.

In both of the 200 ng data sets, the unmodified RNA had a lower IRF activation signal than seen in the 50 ng transfections. As this coincided with a low luciferase expression signal one possible explanation for this observation is that the unmodified RNA could be driving higher PKR activation, causing a global inhibition in translation. The NF-κB signal caused by the unmodified RNA was nearly indistinguishable from that seen in untreated cells.

Taken together, the data elucidates the role of each individual chemically modified nucleotide on the RNA. All samples in which uridine was fully substituted with 5hmU result in low NF-κB, which may suggest the involvement of 5hmU in reducing TLR signaling. Conversely, all samples in which cytidine was fully substituted with Ac4C resulted in low IRF, which may suggest the involvement of Ac4C in reducing signaling through cytosolic innate immune sensors. Full innate immune evasion was only seen when both chemically modified nucleotides were used at 100% substitution, regardless of the dose. One of the observations from FIGS. 18 and 19 is that using both chemically modified nucleotides at full substitution at the 50 ng dose led to a decoupling of NF-κB and IRF activation. Without wishing to be bound by any particular theory, low IRF activation with comparatively higher NF-κB activation may suggest a transition to protein driven NF-κB activation, as NF-κB activation seems to begin to correlate with higher Luciferase expression. The data shows that there is a strong synergy between the two modified nucleotides (ac4c and 5-hmU). This observed synergy is demonstrated, e.g., with doubly modified RNAs largely outperforming RNA having only each of the individual modifications.

This disclosure is the first to report the modified nucleotide combination of ac4C and 5-hmU, and its associated beneficial effects. While the use of both a modified U and C nucleotides in combination has been previously described (see U.S. Pat. No. 8,278,036), the presently disclosed combination of ac4C and 5hmU is categorically different from the aforementioned combination of pseudouridine (T) and 5-methylcytosine (m5C). More recent work has suggested that m5C may actually detract from the positive effects of N1-methylpseudouridine (Svitkin, et al., NAR 2017). Since we instead see direct synergy between our two modifications our combination represents a clear improvement over the state of the art in chemically-modified RNAs.

Also provided herein is data which demonstrates that the ac4C/5hmU combination directly inhibits recognition of uncapped RNA. This is the first demonstration, as far as the inventors are aware, of this effect by any chemically modified RNA combination. The IVT workflow used in this Example makes use of co-transcriptional capping with CleanCap AG. The major advantage of this method is that it produces RNA with high capping efficiency reducing downstream processing by avoiding enzymatic capping using the Vaccinia capping system. Unfortunately, co-transcriptional capping also generates uncapped side-products due to the RNA polymerase initiating with a standard nucleotide rather than the cap analog. The uncapped fraction is estimated make up ~4-5% of the product. To address this issue and reduce the immunogenicity associated with sensing of uncapped RNA by RIG-I, it is typical to treat RNA with a phosphatase enzyme that cleaves off the immunogenic 5' triphosphates while leaving the RNA cap intact. Previously published work suggests that in addition to 5' triphosphates, another ligand for RIG-I is polyU/UC in the RNA sequence (Schnell, Loo, Marcotrigiano &, Gale, PLoS Pathogen 2012). Accordingly, experiments were conducted to analyze whether RNA doubly-modified with ac4C and 5hmU would reduce the activation of RIG-I upon introduction of sample containing residual uncapped RNA.

For these experiments, before treating the RNA used in FIGS. 16-36 with phosphatase, the RNA was transfected at a dose of 200 ng. FIGS. 37-46 show that unmodified phosphatase-untreated RNA performed substantially worse than unmodified phosphatase-treated RNA. Use of each chemically modified nucleotide individually at full substitution for its unmodified counterpart largely rescued cell viability and expression with phosphatase-untreated treated RNA, but still resulted in high immunogenicity as indicated by the IRF and NF-κB reporters. However, phosphatase-untreated ac4C/5hmU double-modified RNA exhibited almost no innate immunogenicity above background and resulted in both high viability and expression.

Figure 37:
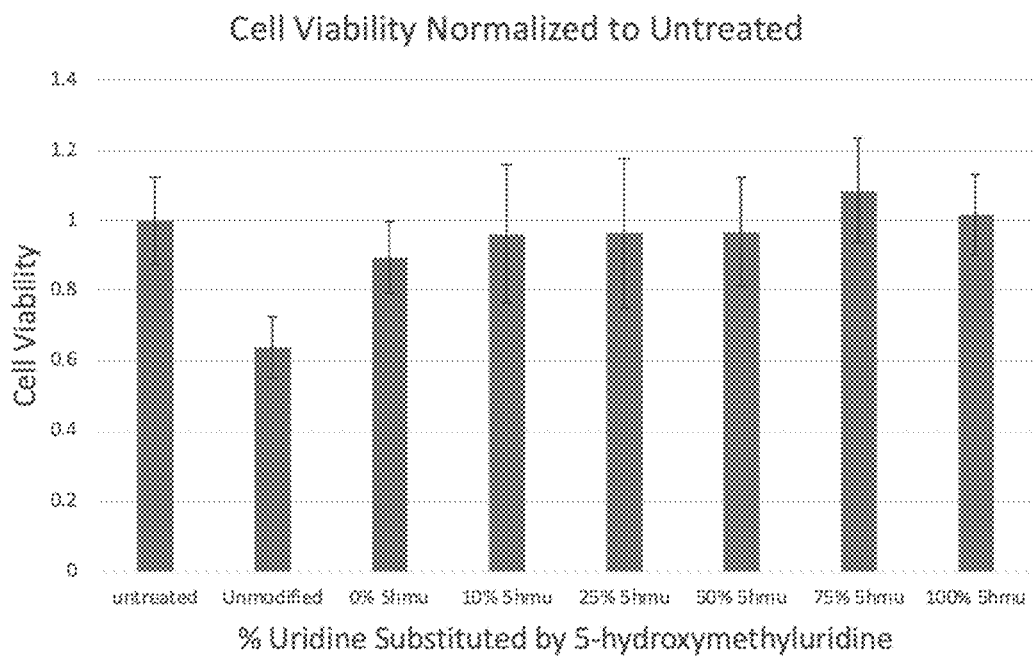
FIG. 37 shows Cell Viability by RNA synthesized using indicated percentage of 5-hydroxymethyluridine instead of natural uridine in combination with 100% Ac4C for Cytidine at a dose of 200 ng without CIAP treatment.
Figure 38:
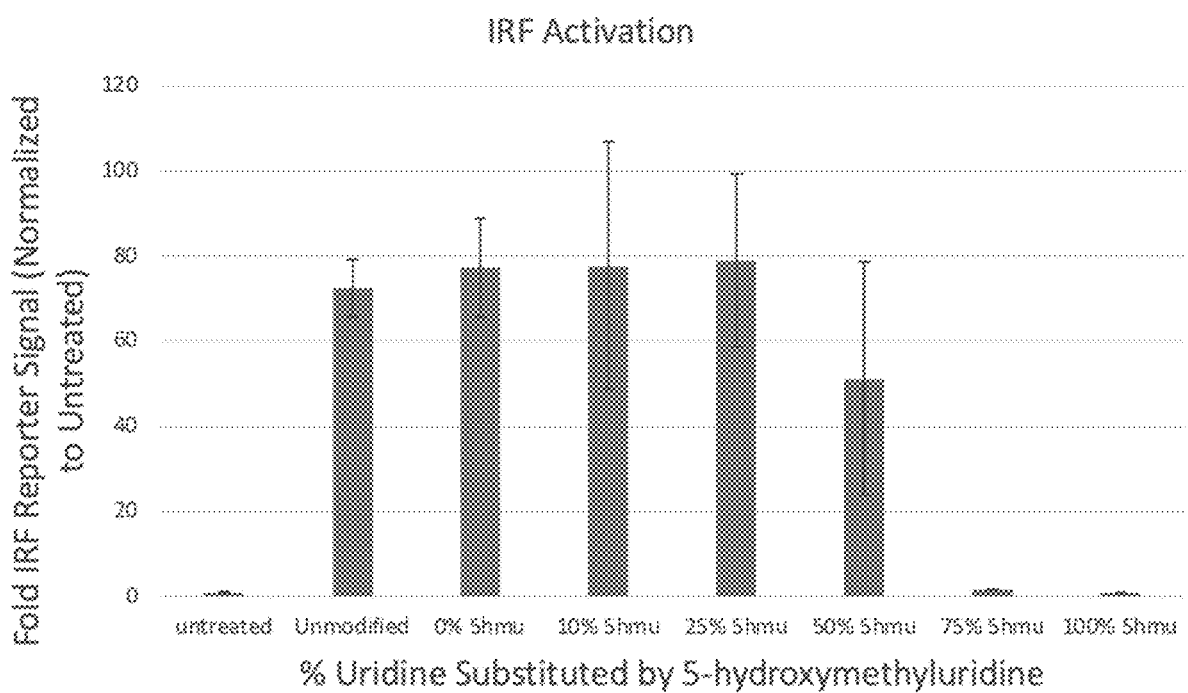
FIG. 38 shows IRF Reporter Activation by RNA synthesized using indicated percentage of 5-hydroxymethyluridine instead of natural uridine in combination with 100% Ac4C for Cytidine at a dose of 200 ng without CIAP treatment.
Figure 39:
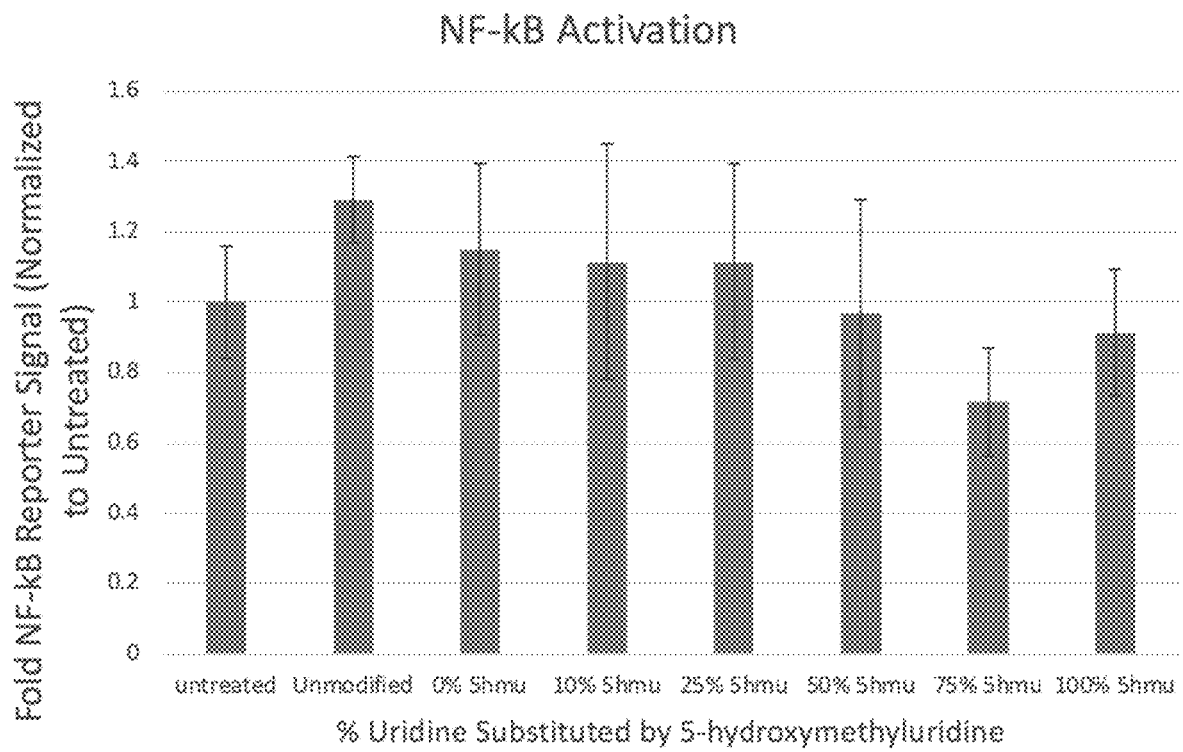
FIG. 39 shows NF-κB Reporter Activation by RNA synthesized using indicated percentage of 5-hydroxymethyluridine instead of natural uridine in combination with 100% Ac4C for Cytidine at a dose of 200 ng without CIAP treatment.
Figure 40:
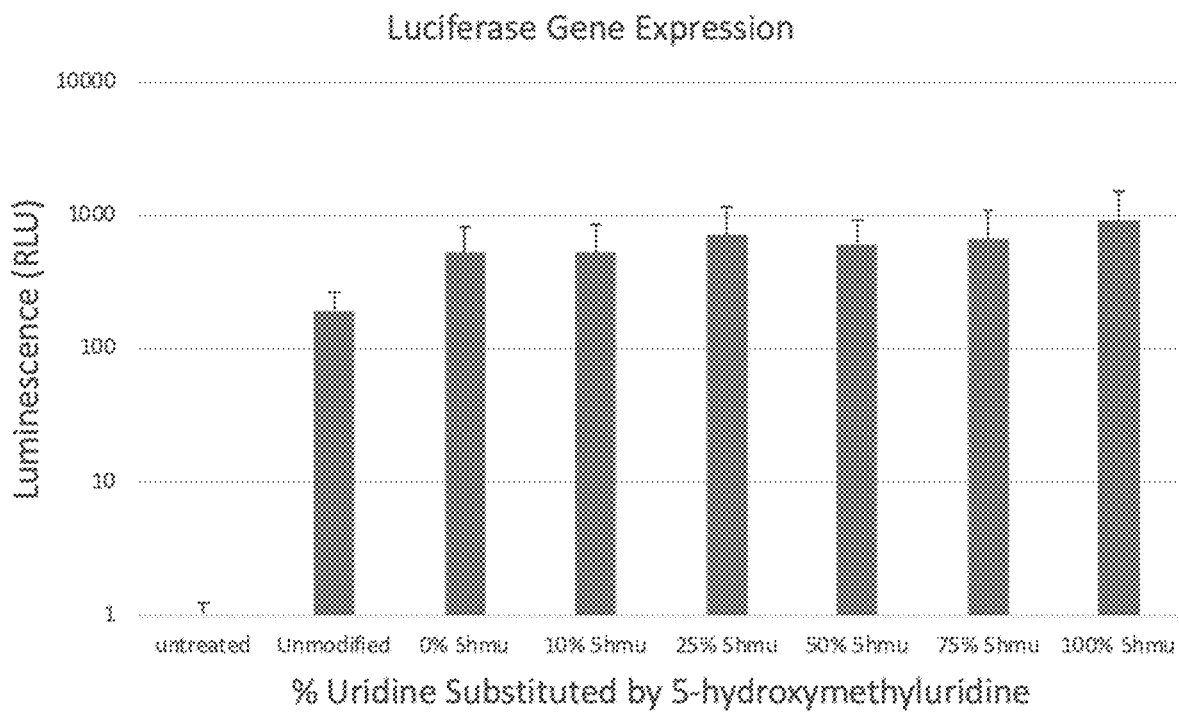
FIG. 40 shows Luciferase gene expression normalized to untreated by RNA synthesized using indicated percentage of 5-hydroxymethyluridine instead of natural uridine in combination with 100% Ac4C for Cytidine at a dose of 200 ng without CIAP treatment.
Figure 41:
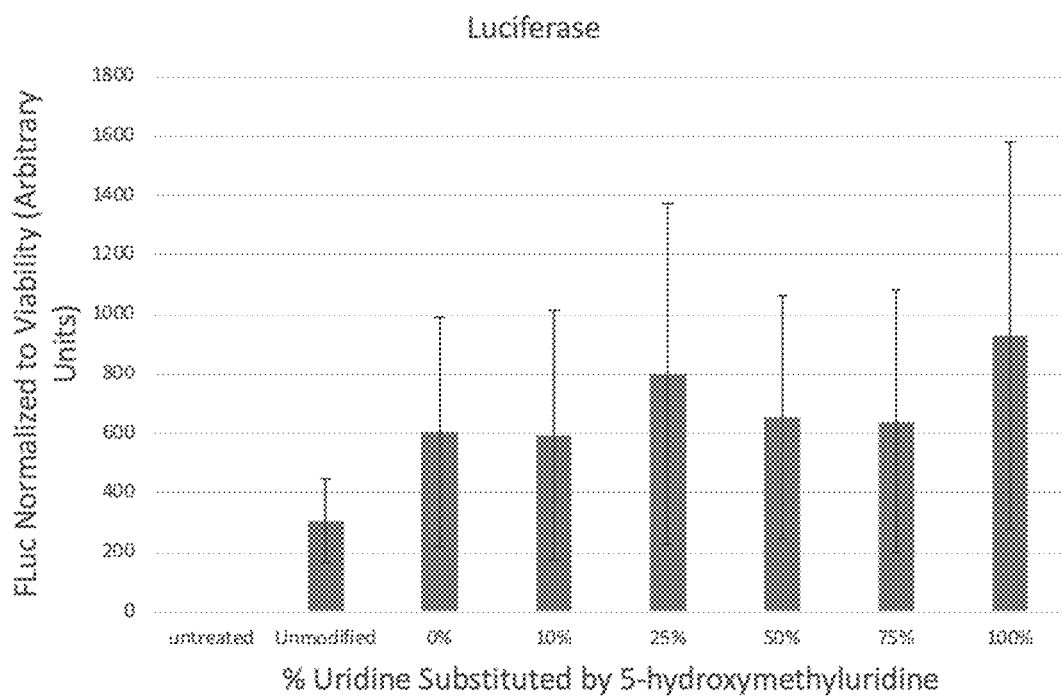
FIG. 41 shows Luciferase gene expression normalized to cell viability by RNA synthesized using indicated percentage of 5-hydroxymethyluridine instead of natural uridine in combination with 100% Ac4C for Cytidine at a dose of 200 ng without CIAP treatment.

FIG. 37 shows that cell viability for phosphatase-untreated ac4C/5hmU double-modified RNA was highest when the RNA had 100% ac4C for cytidines and more than about 75% 5-hydroxymehtyluridine for uridines. The same RNAs as in FIG. 37 were tested for IRF activation (FIG. 38), NF-κB activation (FIG. 39) and reporter expression (FIGS. 40-41). FIG. 38 shows no IRF activation with phosphatase-untreated ac4C/5hmU double-modified RNA when the RNA had 100% ac4C for cytidines and more than about 75% 5-hydroxymehtyluridine for uridines. FIG. 39 shows that NF-κB activation was dampened by about 40% when the RNA had 100% ac4C for cytidines and more than about 75% 5-hydroxymehtyluridine for uridines (compared to unmodified RNA), and NF-κB activation was dampened by about 20% when the RNA had 100% ac4C for cytidines and more than about 75% 5-hydroxymehtyluridine for uridines (compared to unmodified RNA). FIGS. 40-41 show high reporter expression when the RNA had 100% ac4C for cytidines and 0-100% 5-hydroxymehtyluridine for uridines.

Figure 42:
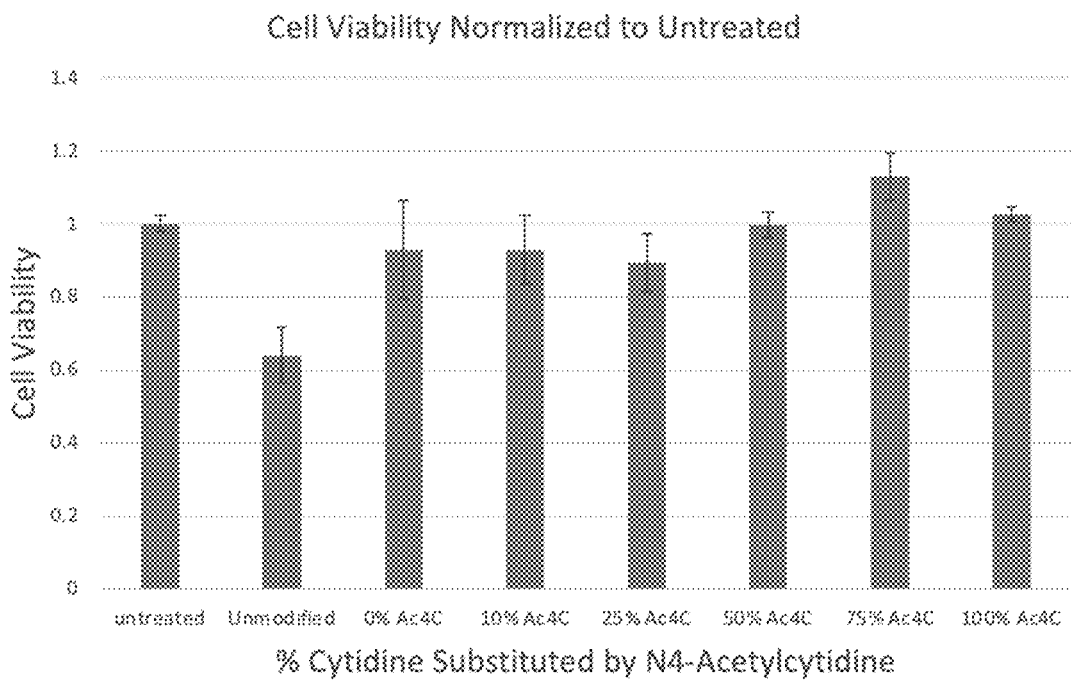
FIG. 42 shows Cell Viability by RNA synthesized using indicated percentage of N4-Acetylcytidine instead of natural cytidine in combination with 100% 5hmu for uridine at a dose of 200 ng without CIAP treatment.
Figure 43:
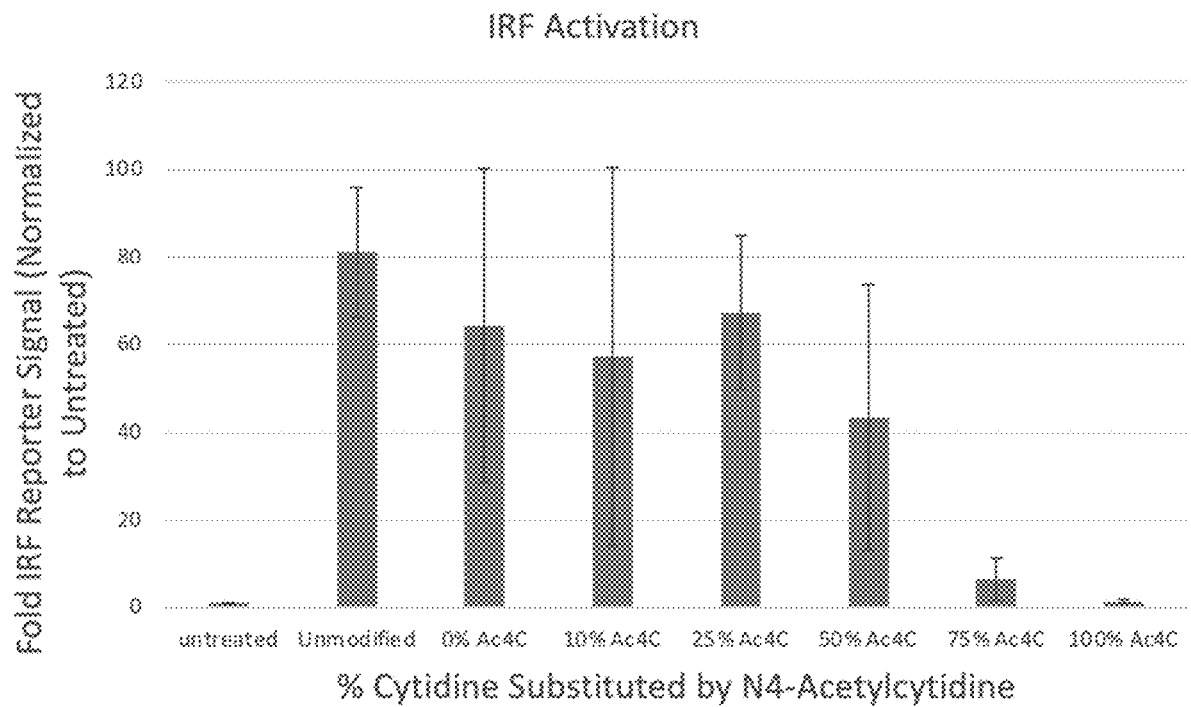
FIG. 43 shows IRF Reporter Activation by RNA synthesized using indicated percentage of N4-Acetylcytidine instead of natural cytidine in combination with 100% 5hmu for uridine at a dose of 200 ng without CIAP treatment.
Figure 44:
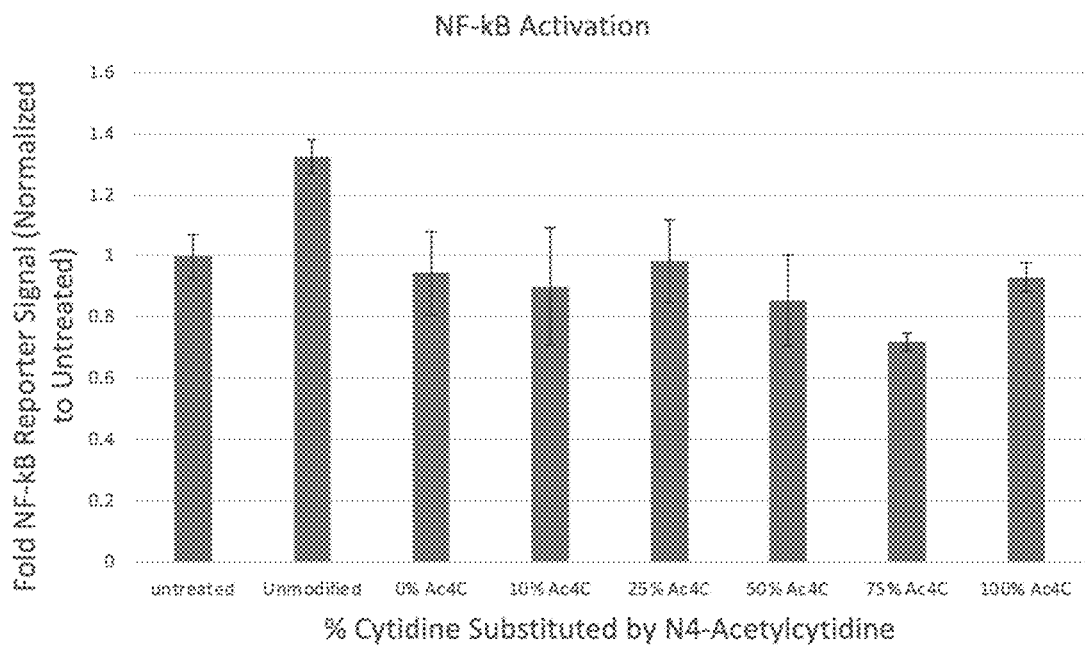
FIG. 44 shows NF-κB Reporter Activation by RNA synthesized using indicated percentage of N4-acetylcytidine instead of natural cytidine in combination with 100% 5hmu for uridine at a dose of 200 ng without CIAP treatment.
Figure 45:
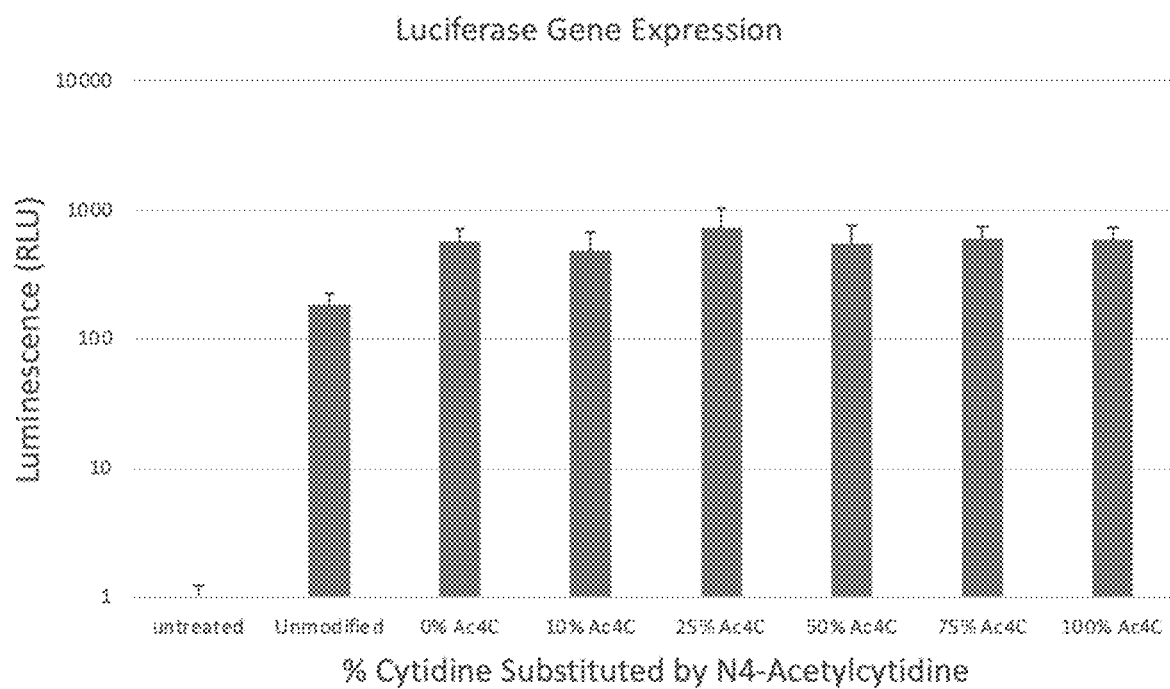
FIG. 45 shows Luciferase gene expression normalized to untreated by RNA synthesized using indicated percentage of n4-acetylcytidine instead of natural cytidine in combination with 100% 5hmu for uridine at a dose of 200 ng without CIAP treatment.
Figure 46:
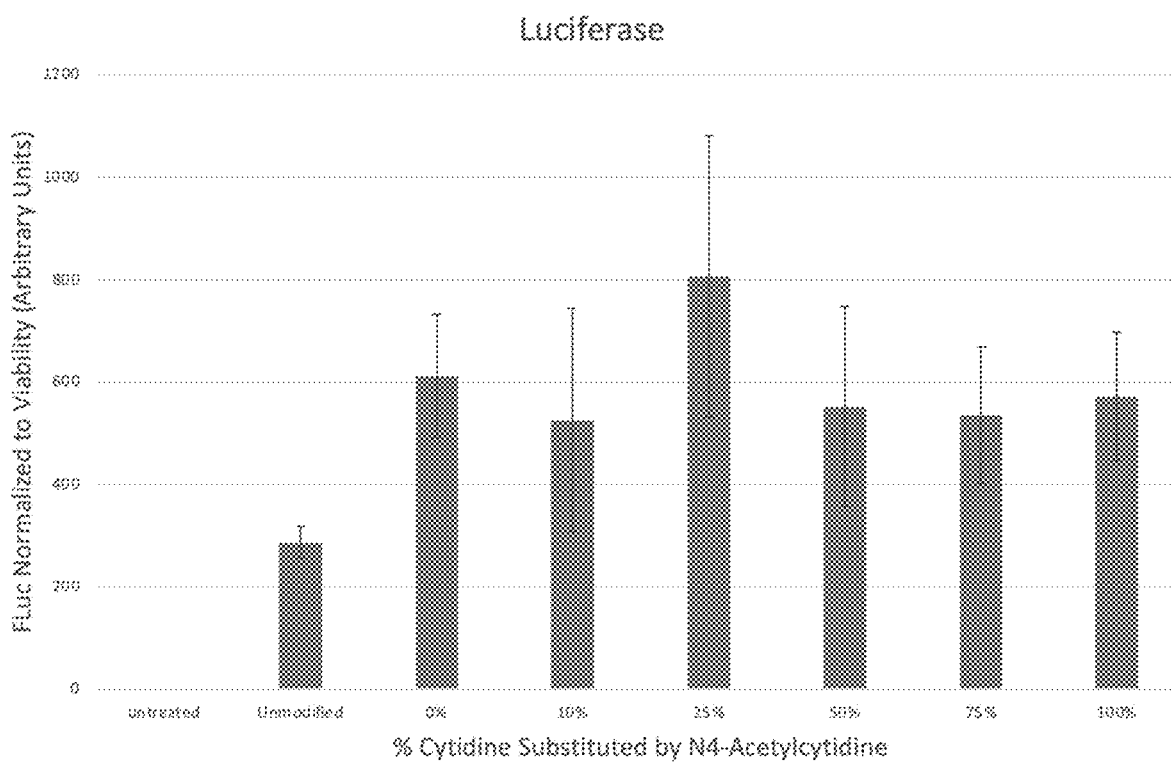
FIG. 46 shows Luciferase gene expression normalized to cell viability by RNA synthesized using indicated percentage of N4-acetylcytidine instead of natural cytidine in combination with 100% 5hmu for uridine at a dose of 200 ng without CIAP treatment.

FIG. 42 shows that cell viability for phosphatase-untreated ac4C/5hmU double-modified RNA was highest when the RNA had 100% 5-hydroxymethyluridines for uridines and more than about 50% ac4C for cytidines. The same RNAs as in FIG. 41 were tested for IRF activation (FIG. 43), NF-κB activation (FIG. 44), and reporter expression (FIGS. 45-46). FIG. 43 shows significantly reduced IRF activation with phosphatase-untreated ac4C/5hmU double-modified RNA when the RNA had 100% 5-hydroxymethyluridines for uridines and more than about 50% ac4C for cytidines (compared to unmodified RNA). No IRF activation was observed when the RNA had 100% 5-hydroxymethyluridines for uridines and 100% ac4C for cytidines. FIG. 44 shows reduced NF-κB activation when the RNA had 100% 5-hydroxymethyluridines for uridines and about 50-75% of ac4C for cytidines. FIGS. 45-46 show high reporter expression when the RNA had 100% 5-hydroxymethyluridines for uridines and about 0-100% of ac4C for cytidines.

Figure 10:
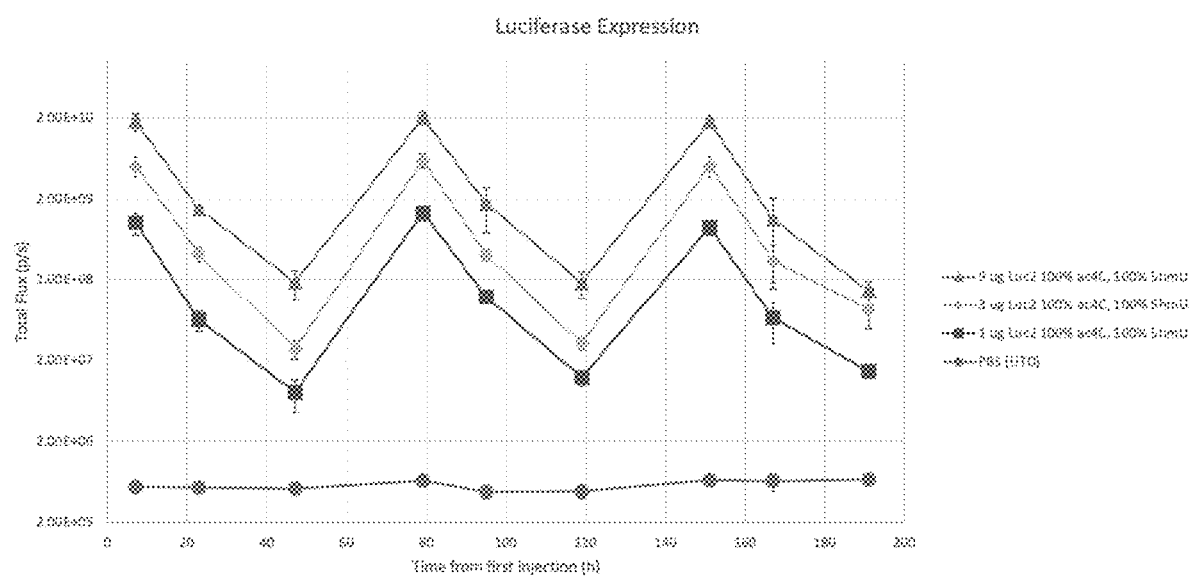
FIG. 10 shows luciferase reporter gene expression with repeated dosing of 100% Ac4C/100% 5hmU modified RNA at 72 hour intervals.

A number of experiments were conducted to test the effects of the novel chemically modified RNA disclosed herein, in an in vivo model. It was observed that 100% Ac4C/100%5hmU RNA outperformed the state of the art RNA using N1-methylpseudouridine. FIG. 10 shows that repeated dosing of the double modified RNA, across a therapeutically relevant dose range, at the relatively short interval of 72 hours, resulted in protein expression that is equivalent at each dose. Until now, repeated dosing at short intervals like this results in gradually lower expression at each repeat dose due to systemic immune stimulation at each dose. This has prevented RNA from being used for frequent dosing in therapeutic indications. This application is the first to show that an RNA comprising modifications disclosed herein, e.g., Ac4C and/or 5hmU, does not have this limitation and can be used for repeated dosing, e.g., frequent repeated dosing, in therapeutic applications.

Figure 47:
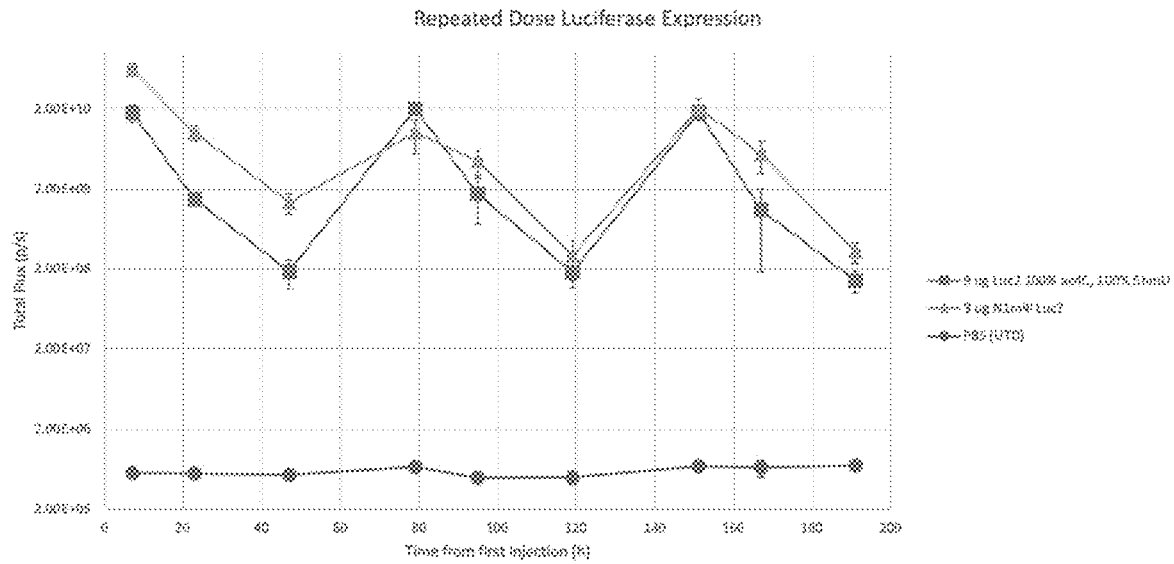
FIG. 47 shows luciferase reporter gene expression with repeated dosing of 9 ug 100% Ac4C/100% 5hmU modified RNA vs 100% N1-methylpseudouridine modified RNA at 72 hour intervals.
Figure 48:
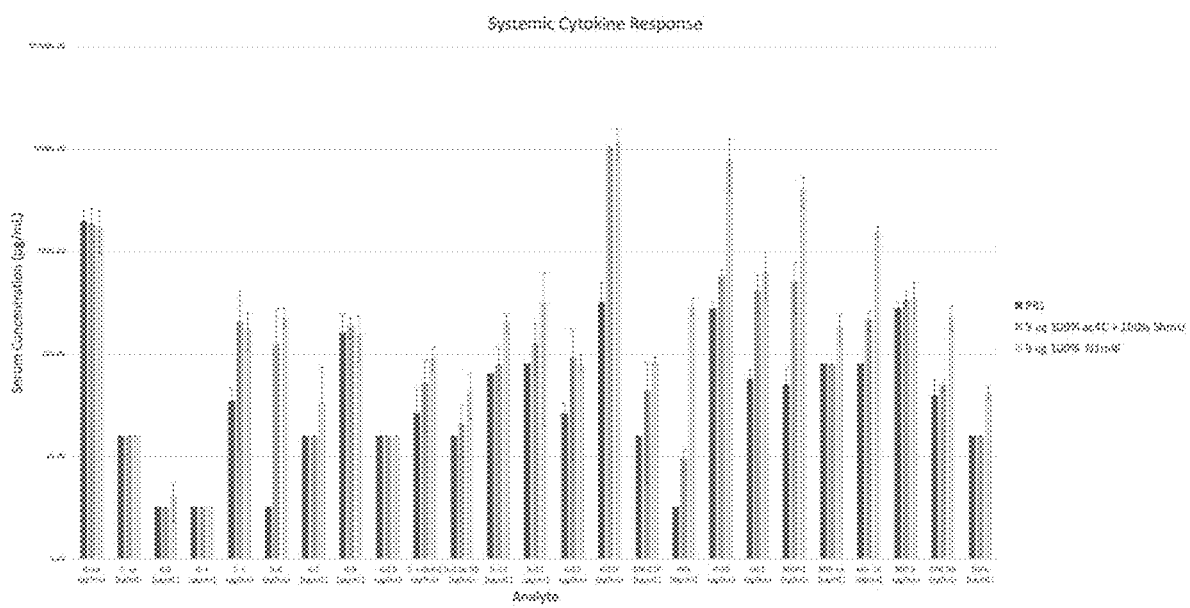
FIG. 48 shows systemic cytokine response to 9 ug 100% Ac4C/100% 5hmU Luc2 RNA vs. 100% N1-methylpseudouridine Luc2 RNA.

FIG. 47 shows that the modified RNA also resulted in more equivalent reporter protein expression at 72 hour repeat doses in comparison to the state of the art, N1-methylpseudouridine modified RNA, at the high murine dose of 9 ug. Since mammalian immune systems evolved inflammatory pathways to respond to exogenous nucleic acids and shut down pathogenic replication, it is reasonable to assume that equivalent protein expression can be obtained at each repeat dosing due to a best in class reduction in RNA immunogenicity with the modified RNA disclosed herein. This point is exemplified in FIG. 48 in which the high dose of 9 ug of N1-Methylpseudouridine RNA resulted in higher levels of key systemic inflammatory markers compared to 9 ug of the modified RNA disclosed herein. This data also suggests that in some embodiments, a higher dose of RNA can be delivered with better patient tolerability using modified RNAs disclosed herein, due to a lower inflammatory response.

FIG. 49 shows that vaccination with a 100% Ac4C/100%5hmU RNA encoding a SARS-CoV-2 vaccine candidate led to higher IgG titers than unmodified RNA or RNA having 100% Ac4C only. Without being bound to any particular theory, this may be a function of higher expression and availability of antigen to the immune system, which allows more immune cells to recognize the antigen and contribute to higher antibody titers.

These data demonstrate that fully substituting natural C and U nucleosides with ac4C and 5hmU inhibits innate immune sensing and results in increased expression of the protein encoded by the RNA. This combination of ac4C and 5hmU modified nucleotides is the first nucleotide combination shown to directly inhibit sensing of uncapped RNA. Improved results were obtained when large proportions of both nucleotides were substituted (e.g., about or more than 75% substitution with both nucleotides). In some embodiments, the percentage of substitution of each nucleotide is 100%, rather than an undetermined percentage of <100%.

Innate immune sensing of RNA remains a major barrier in using RNA in applications that involve repeat dosing and or/high dose regimens, including gene therapy and enzyme replacement. The data described herein have major implications for extending the utility of RNA as a therapeutic modality. The data suggest that innate immune evasion can be achieved with polyribonucleotides comprising ac4C and 5hmU.

Exemplary Embodiments

Embodiment 1. A modified ribonucleotide comprising a nucleoside comprising an acetyl group, wherein the nucleoside is N4-acetylcytidine and the modified ribonucleotide has: (a) a 5' monophosphate; (b) a 5' diphosphate; or (c) a 5' triphosphate and a structure of:

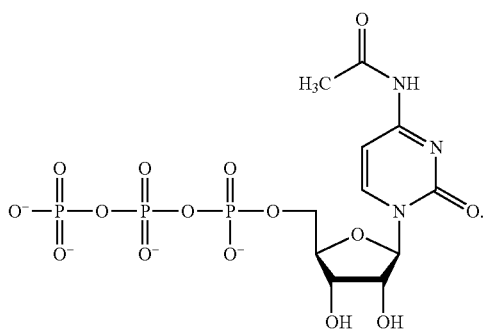

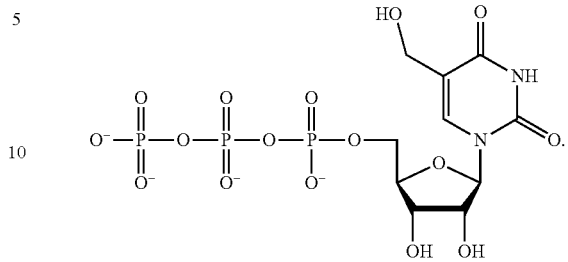

fied ribonucleotide has: (a) a 5' monophosphate; (b) a 5' diphosphate; or (c) a 5' triphosphate and a structure of:

Embodiment 2. A polyribonucleotide comprising one or more modified ribonucleotides according to embodiment 1.

Embodiment 3. The polyribonucleotide of embodiment 2, wherein the polyribonucleotide comprises cytidine residues, wherein at least 5% of cytidine residues in the polyribonucleotide comprise N4-acetylcytidine.

Embodiment 4. The polyribonucleotide of embodiment 3, wherein the polyribonucleotide comprises cytidine residues, wherein less than 100% of cytidine residues in the polyribonucleotide comprise N4-acetylcytidine.

Embodiment 5. The polyribonucleotide of any one of embodiments 2 to 4, wherein the polyribonucleotide comprises cytidine residues and wherein about 5% to 99%, about 5% to 95%, about 5% to 90%, about 5% to 85%, about 5% to 80%, about 5% to 75%, about 5% to 70%, about 5% to 65%, about 5% to 60%, about 5% to 55%, about 5% to 50%, about 5% to 45%, about 5% to 40%, about 5% to 35%, about 5% to 30%, about 5% to 25%, about 5% to 20%, about 5% to 15%, about 5% to 10%, about 10% to 99%, about 15% to 99%, about 20% to 99%, about 25% to 99%, about 30% to 99%, about 35% to 99%, about 40% to 99%, about 45% to 99%, about 50% to 99%, about 55% to 99%, about 60% to 99%, about 65% to 99%, about 70% to 99%, about 80% to 99%, about 85% to 99%, about 90% to 99%, or about 95% to 99% of cytidine residues in the polyribonucleotide comprise N4-acetylcytidine.

Embodiment 6. The polyribonucleotide of any one of embodiments 2 to 4, wherein the polyribonucleotide comprises cytidine residues and wherein at least about 5%, at least about 10%, at least about 15%, at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, or at least about 99% of cytidine residues in the polyribonucleotide comprise N4-acetylcytidine.

Embodiment 7. The polyribonucleotide of any one embodiments 2-6, wherein the polyribonucleotide further comprises one or more modified ribonucleotides other than N4-acetylcytidine.

Embodiment 8. The polyribonucleotide of embodiment 7, wherein the one or more modified ribonucleotides comprises a nucleoside chosen from: an adenosine, a guanosine, a cytidine or a uridine, or a combination thereof.

Embodiment 9. The polyribonucleotide of embodiment 7 or 8, wherein the one or more modified ribonucleotides comprises a hydroxymethyl group.

Embodiment 10. The polyribonucleotide of embodiment 9, wherein the nucleoside of the one or more modified ribonucleotides is 5-hydroxymethyluridine, and the modi- Embodiment 11. The polyribonucleotide of any one of embodiments 7-10, wherein the polyribonucleotide comprises uridine residues and wherein at least about 5% of the uridines in the polyribonucleotide comprise 5-hydroxymethyluridine.

Embodiment 12. The polyribonucleotide of any one of embodiments 7-10, wherein the polyribonucleotide comprises uridine residues and wherein less than 100% of the uridines in the polyribonucleotide comprise 5-hydroxymethyluridine.

Embodiment 13. The polyribonucleotide of any one of embodiments 7-12, wherein the polyribonucleotide comprises uridine residues and wherein about 5% to 99%, about 5% to 95%, about 5% to 90%, about 5% to 85%, about 5% to 80%, about 5% to 75%, about 5% to 70%, about 5% to 65%, about 5% to 60%, about 5% to 55%, about 5% to 50%, about 5% to 45%, about 5% to 40%, about 5% to 35%, about 5% to 30%, about 5% to 25%, about 5% to 20%, about 5% to 15%, about 5% to 10%, about 10% to 99%, about 15% to 99%, about 20% to 99%, about 25% to 99%, about 30% to 99%, about 35% to 99%, about 40% to 99%, about 45% to 99%, about 50% to 99%, about 55% to 99%, about 60% to 99%, about 65% to 99%, about 70% to 99%, about 80% to 99%, about 85% to 99%, about 90% to 99%, or about 95% to 99% of uridines in the polyribonucleotide comprise 5-hydroxymethyluridine.

Embodiment 14. The polyribonucleotide of any one of embodiments 7-13, wherein the polyribonucleotide comprises uridine residues and wherein at least about 5%, at least about 10%, at least about 15%, at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, or at least about 99% of uridines in the polyribonucleotide comprise 5-hydroxymethyluridine.

Embodiment 15. The polyribonucleotide of any one of embodiments 2 to 14, characterized in that when assessed in a cell, tissue or an organism that has been administered the polyribonucleotide, reduced immunogenicity is observed relative to an appropriate reference comparator.

Embodiment 16. The polyribonucleotide of embodiment 15, wherein a reference comparator comprises an otherwise similar cell, tissue or organism that has been administered a comparable polyribonucleotide that includes fewer acetyl groups on a nucleobase (e.g., does not include any acetyl groups on a nucleobase) than a polyribonucleotide in a composition.

Embodiment 17. The polyribonucleotide of embodiment 15 or 16, wherein reduced immunogenicity comprises reduced activation of an innate immune response induced toxicity.

Embodiment 18. The polyribonucleotide of embodiment 17, wherein reduced activation of an immune response comprises reduced activation of pathways of NFkb, IRF, and/or other cytokines resulting from inflammation in the cell, tissue or organism.

Embodiment 19. The polyribonucleotide of any one of embodiments 15-18, wherein reduced immunogenicity allows for repeated dosing of the polyribonucleotide.

Embodiment 20. The polyribonucleotide of embodiment 19, wherein reduced immunogenicity allows for administration of a higher dose of the polyribonucleotide related to an appropriate reference comparator.

Embodiment 21. The polyribonucleotide of embodiment 20, wherein a reference comparator comprises a comparable polyribonucleotide that includes fewer acetyl groups on a nucleobase (e.g., does not include any acetyl groups on a nucleobase).

Embodiment 22. The polyribonucleotide of any one of embodiments 2 to 21, characterized in that when assessed in a cell, tissue or an organism that has been administered the polyribonucleotide, increased cell viability is observed relative to an appropriate reference comparator.

Embodiment 23. The polyribonucleotide of embodiment 22, wherein a reference comparator is the cell viability of a cell, tissue or organism that has been administered a comparable polyribonucleotide that includes fewer acetyl groups on a nucleobase (e.g., does not include any acetyl groups on a nucleobase).

Embodiment 24. The polyribonucleotide of embodiment 22 or 23, wherein cell viability is a measure of the length of time one or more cells of the cell, tissue or subject live.

Embodiment 25. The polyribonucleotide of embodiment 23 or 24, wherein cell viability is a measure of a number of cells of the cell, tissue or subject alive at one or more time points.

Embodiment 26. The polyribonucleotide of any one of embodiments 2-25, wherein the polyribonucleotide is or comprises a messenger RNA (mRNA).

Embodiment 27. The polyribonucleotide of any one of embodiments 2-25, wherein the polyribonucleotide is or comprises an RNA oligo.

Embodiment 28. The polyribonucleotide of any one of embodiments 2-25, wherein the polyribonucleotide is or comprises a gRNA.

Embodiment 29. The polyribonucleotide of any one of embodiments 2-25, wherein the polyribonucleotide is or comprises an inhibitory RNA.

Embodiment 30. The polyribonucleotide of embodiment 29, wherein the polyribonucleotide is or comprises an miRNA or siRNA.

Embodiment 31. The polyribonucleotide of any one of embodiments 2-25, wherein the polyribonucleotide is or comprises an antisense oligonucleotide.

Embodiment 32. A composition comprising one or more polyribonucleotides of any one of embodiments 2-31.

Embodiment 33. The composition of embodiment 32, wherein the composition is a pharmaceutical composition.

Embodiment 34. The composition of embodiment 33, wherein the pharmaceutical composition is or comprises an immunogenic composition.

Embodiment 35. The composition of embodiment 33, wherein the pharmaceutical composition is or comprises a vaccine.

Embodiment 36. The composition of embodiment 33, wherein the pharmaceutical composition is or comprises a gene therapy.

Embodiment 37. The composition of embodiment 33, wherein the pharmaceutical composition is or comprises a chemotherapy.

Embodiment 38. The composition of embodiment 33, wherein the pharmaceutical composition is or comprises a protein replacement therapy.

Embodiment 39. The composition of embodiment 33, wherein the pharmaceutical composition is or comprises an immunotherapy, an antibody therapy, and/or an immune-modulation therapy.

Embodiment 40. The composition of embodiment 33, wherein the pharmaceutical composition is or comprises a cell engineering therapy.

Embodiment 41. The composition of any one of embodiments 32-30, wherein the composition comprises double stranded RNA.

Embodiment 42. A method comprising administering one or more polyribonucleotides according to any one of embodiments 2-31, or a composition according to any one of embodiments 32-41 to a cell, tissue or subject.

Embodiment 43. The method of embodiment 42, further comprising determining cell viability of the cell, tissue or subject.

Embodiment 44. The method of embodiment 43, wherein cell viability is a measure of the length of time one or more cells of the cell, tissue or subject live.

Embodiment 45. The method of embodiment 44, wherein cell viability is a measure of a number of cells of the cell, tissue or subject alive at one or more time points.

Embodiment 46. The method of any one of embodiments 43-45, wherein the cell, tissue or subject to which the polyribonucleotide or a composition comprising the same has been administered exhibits improved cell viability as compared to a reference cell viability.

Embodiment 47. The method of embodiment 46, wherein the reference cell viability is the cell viability of a cell, tissue or subject that has been administered a comparable polyribonucleotide or a composition comprising the same that includes fewer acetyl groups on a nucleobase (e.g., does not include any acetyl groups on a nucleobase).

Embodiment 48. The method of any one of embodiments 43-47, further comprising determining an immune system response of the cell, tissue or subject to which the polyribonucleotide or a composition comprising the same has been administered.

Embodiment 49. The method of embodiment 48, wherein the immune response comprises an innate immune system response comprising innate immune system induced toxicity.

Embodiment 50. The method of embodiment 49, wherein determining an innate immune system response comprises determining a level of NF-κB, IRF, and/or other inflammatory cytokines in the cell, tissue or subject.

Embodiment 51. The method of any one of embodiments 48-50, wherein the cell, tissue or subject to which the polyribonucleotide or a composition comprising the same has been administered exhibits a reduced innate immune system response as compared to a reference.

Embodiment 52. The method of embodiment 51, wherein the reference is an innate immune system response of a cell, tissue or subject that has been administered a comparable polyribonucleotide or a composition comprising the same that includes fewer acetyl groups on a nucleobase (e.g., does not include any acetyl groups on a nucleobase).

Embodiment 53. The method of any one of embodiments 42-52, further comprising determining efficacy of the polyribonucleotide or a composition comprising the same in the cell, tissue or subject to which the polyribonucleotide or a composition comprising the same has been administered.

Embodiment 54. The method of embodiment 53, wherein determining efficacy comprises determining an antibody response or cellular response in the cell, tissue or subject.

Embodiment 55. The method of embodiment 54, wherein the cell, tissue or subject to which the polyribonucleotide or a composition comprising the same has been administered exhibits an increased antibody response or cellular response as compared to a reference.

Embodiment 56. The method of embodiment 55, wherein the reference is an antibody response or cellular response of a cell, tissue or subject that has been administered a comparable polyribonucleotide or a composition comprising the same that includes fewer acetyl groups on a nucleobase (e.g., does not include any acetyl groups on a nucleobase).

Embodiment 57. The method of any one of embodiments 42-56, wherein the method comprises administering the polyribonucleotide or a composition comprising the same to the cell, tissue or subject at least two times.

Embodiment 58. The method of any one of embodiments 42-57, wherein the method comprises administering the polyribonucleotide or a composition comprising the same to the cell, tissue or subject 2 times, 3 times, 4 times, 5 times, 6 times, 7 times, 8 times, 9 times or 10 times.

Embodiment 59. The method of embodiment 57 or 58, wherein at least two administrations of the polyribonucleotide or a composition comprising the same to the cell, tissue or subject does not result in reduced efficacy of the polyribonucleotide or a composition comprising the same compared to administration of one dose of the polyribonucleotide or a composition comprising the same.

Embodiment 60. The method of any one of embodiments 42-59, wherein the method comprises administering the polyribonucleotide or a composition comprising the same to the cell, tissue or subject at a higher dose compared to an appropriate reference comparator.

Embodiment 61. The method of embodiment 60, wherein the reference comparator comprise a comparable polyribonucleotide that includes fewer acetyl groups on a nucleobase (e.g., does not include any acetyl groups on a nucleobase).

Embodiment 62. The method of any one of embodiments 42-61, wherein the cell is a mammalian cell, the tissue is a mammalian tissue, or the subject is a mammal.

Embodiment 63. The method of embodiment 62, wherein the mammal is a human.

Embodiment 64. The method of any one of embodiments 42-63, wherein the method is a method to stimulate an immune response.

Embodiment 65. The method of any one of embodiments 42-64, wherein the method is a vaccination method.

Embodiment 66. The method of any one of embodiments 42-64, wherein the method is a gene therapy method.

Embodiment 67. The method of any 66, wherein the gene therapy method comprises delivery of one or more components of a gene therapy such as a gRNA.

Embodiment 68. The method of any one of embodiments 42-64, wherein the method is a cell therapy engineering method.

Embodiment 69. The method of any one of embodiments 42-64, wherein the method is an immunotherapy method or an antibody therapy method.

Embodiment 70. The method of embodiment 69, wherein the immunotherapy method comprises delivery an immune-modulation therapy, and/or an immune checkpoint therapy.

Embodiment 71. The method of any one of embodiments 42-63, wherein the method is a protein replacement therapy method.

Embodiment 72. The method of embodiment 71, wherein the protein replacement therapy method comprises delivery of an enzyme replacement therapy.

Embodiment 73. The method of any one of embodiments 42-64, wherein the method is a chemotherapeutic method.

Embodiment 74. A method of vaccination comprising administering one or more polyribonucleotides according to any one of embodiments 2-31, or a composition according to any one of embodiments 32-41 to a cell, tissue or subject.

Embodiment 75. A method of immunotherapy comprising administering one or more polyribonucleotides according to any one of embodiments 2-31, or a composition according to any one of embodiments 32-41 to a cell, tissue or subject.

Embodiment 76. A method of gene therapy comprising administering one or more polyribonucleotides according to any one of embodiments 2-31, or a composition according to any one of embodiments 32-41 to a cell, tissue or subject.

Embodiment 77. A method of protein replacement therapy, comprising administering one or more polyribonucleotides according to any one of embodiments 2-31, or a composition according to any one of embodiments 32-41 to a cell, tissue or subject.

Embodiment 78. A method of cell engineering therapy, comprising administering one or more polyribonucleotides according to any one of embodiments 2-31, or a composition according to any one of embodiments 32-41 to a cell, tissue or subject.

Embodiment 79. A method of manufacturing an RNA composition comprising introducing at least one modified ribonucleotide according to embodiment 1 into a polyribonucleotide.

Embodiment 80. The method of embodiment 79, wherein the method does not comprise removing double-stranded RNA from the RNA composition.

Embodiment 81. A cell comprising a polyribonucleotide according to any one of embodiments 2-31, or a composition according to any one of embodiments 32-41.

Embodiment 82. Use of a modified ribonucleotide according to embodiment 1 in the production of a polyribonucleotide.

Embodiment 83. Use of a polyribonucleotide according to any one of embodiments 2-31, or a composition according to any one of embodiments 32-41 to stimulate an immune response.

Embodiment 84. Use of a polyribonucleotide according to any one of embodiments 2-31, or a composition according to any one of embodiments 32-41 as a vaccine.

Embodiment 85. Use of a polyribonucleotide according to any one of embodiments 2-31, or a composition according to any one of embodiments 32-41 as an immunotherapy, e.g., as an antibody therapy, an immune-modulation therapy, and/or an immune checkpoint therapy.

Embodiment 86. Use of polyribonucleotide according to any one of embodiments 2-31, or a composition according to any one of embodiments 32-41 as a gene therapy.

Embodiment 87. Use of polyribonucleotide according to any one of embodiments 2-31, or a composition according to any one of embodiments 32-41 as a protein replacement therapy.

Embodiment 88. Use of polyribonucleotide according to any one of embodiments 2-31, or a composition according to any one of embodiments 32-41 as a cell engineering therapy.

Embodiment 89. Use of polyribonucleotide according to any one of embodiments 2-31, or a composition according to any one of embodiments 32-41 as a chemotherapy.

Embodiment 90. The use of any one of embodiments 82-89, wherein the polyribonucleotide or a composition comprising the same is administered to a cell, tissue or subject.

Embodiment 91. The use of embodiment 90, wherein the cell is a mammalian cell, the tissue is a mammalian tissue, or the subject is a mammal.

Embodiment 92. The use of embodiment 91, wherein the mammal is a human.

Embodiment 93. A modified ribonucleotide comprising a nucleoside comprising a hydroxymethyl group, wherein the nucleoside is 5-hydroxymethyluridine and the modified ribonucleotide has: (a) a 5' monophosphate; (b) a 5' diphosphate; or (c) a 5' triphosphate and a structure of:

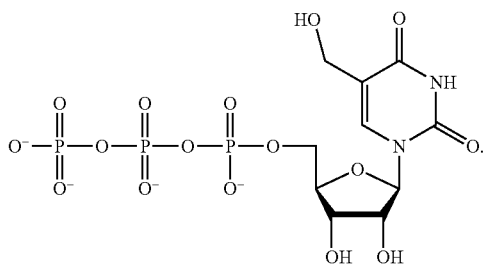

Embodiment 94. A polyribonucleotide comprising one or more modified ribonucleotides according to embodiment 93.

Embodiment 95. The polyribonucleotide of embodiment 94, wherein the polyribonucleotide comprises uridine residues, wherein at least about 5% of uridine residues in the polyribonucleotide comprise 5-hydroxymethyluridine.

Embodiment 96. The polyribonucleotide of embodiment 94, wherein the polyribonucleotide comprises uridine residues, wherein less than 100% of uridine residues in the polyribonucleotide comprise 5-hydroxymethyluridine.

Embodiment 97. The polyribonucleotide of any one of embodiments 94-96, wherein the polyribonucleotide comprises uridine residues and wherein about 5% to 99%, about 5% to 95%, about 5% to 90%, about 5% to 85%, about 5% to 80%, about 5% to 75%, about 5% to 70%, about 5% to 65%, about 5% to 60%, about 5% to 55%, about 5% to 50%, about 5% to 45%, about 5% to 40%, about 5% to 35%, about 5% to 30%, about 5% to 25%, about 5% to 20%, about 5% to 15%, about 5% to 10%, about 10% to 99%, about 15% to 99%, about 20% to 99%, about 25% to 99%, about 30% to 99%, about 35% to 99%, about 40% to 99%, about 45% to 99%, about 50% to 99%, about 55% to 99%, about 60% to 99%, about 65% to 99%, about 70% to 99%, about 80% to 99%, about 85% to 99%, about 90% to 99%, or about 95% to 99% of uridine residues in the polyribonucleotide comprise 5-hydroxymethyluridine.

Embodiment 98. The polyribonucleotide of any one of embodiments 94-96, wherein the polyribonucleotide comprises uridine residues and wherein at least about 5%, at least about 10%, at least about 15%, at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, at least about 99% of uridine residues in the polyribonucleotide comprise 5-hydroxymethyluridine.

Embodiment 99. The polyribonucleotide of any one of embodiments 94-96, wherein the polyribonucleotide comprises uridine residues and wherein more than 60% of uridine residues in the polyribonucleotide comprise 5-hydroxymethyluridine.

Embodiment 100. The polyribonucleotide of embodiment 99, wherein about 60-100%, about 65%-100%, about 70%-100%, about 75%-100%, about 80%-100%, about 85%-100%, about 90%-100%, about 95%-100%, about 60%-95%, about 60%-90%, about 60%-85%, about 60%-80%, about 60%-75%, about 60%-70%, about 60%-65% of uridine residues in the polyribonucleotide comprise 5-hydroxymethyluridine.

Embodiment 101. The polyribonucleotide of embodiment 99 or 100, wherein about 75% of uridine residues in the polyribonucleotide comprise 5-hydroxymethyluridine.

Embodiment 102. The polyribonucleotide of embodiment 99 or 100, wherein 100% of uridine residues in the polyribonucleotide comprise 5-hydroxymethyluridine.

Embodiment 103. The polyribonucleotide of any one of embodiments 94-102, wherein the polyribonucleotide further comprises one or more modified ribonucleotides other than 5-hydroxymethyluridine.

Embodiment 104. The polyribonucleotide of embodiment 103, wherein the one or more modified ribonucleotides comprises a nucleoside chosen from: an adenosine, a guanosine, a cytidine or a uridine, or a combination thereof.

Embodiment 105. The polyribonucleotide of embodiment 103 or 104, wherein the one or more modified ribonucleotides comprises an acetyl group.

Embodiment 106. The polyribonucleotide of embodiment 103-105, wherein the nucleoside of the one or more modified ribonucleotides is N4-acetylcytidine and the modified ribonucleotide has: (a) a 5' monophosphate; (b) a 5' diphosphate; or (c) a 5' triphosphate and a structure of:

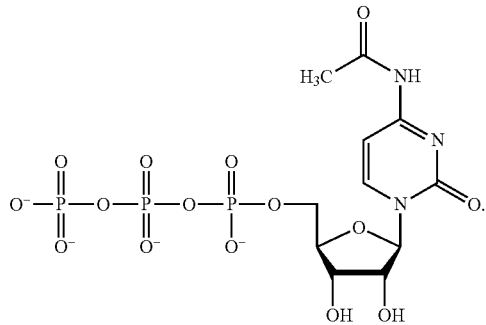

Embodiment 107. The polyribonucleotide of embodiment 106, wherein the polyribonucleotide comprises cytidine residues, wherein at least 5% of cytidine residues in the polyribonucleotide comprise N4-acetylcytidine.

Embodiment 108. The polyribonucleotide of embodiment 106, wherein the polyribonucleotide comprises cytidine residues, wherein less than 100% of cytidine residues in the polyribonucleotide comprise N4-acetylcytidine.

Embodiment 109. The polyribonucleotide of any one of embodiments 106-108, wherein the polyribonucleotide comprises cytidine residues and wherein about 5% to 99%, about 5% to 95%, about 5% to 90%, about 5% to 85%, about 5% to 80%, about 5% to 75%, about 5% to 70%, about 5% to 65%, about 5% to 60%, about 5% to 55%, about 5% to 50%, about 5% to 45%, about 5% to 40%, about 5% to 35%, about 5% to 30%, about 5% to 25%, about 5% to 20%, about 5% to 15%, about 5% to 10%, about 10% to 99%, about 15% to 99%, about 20% to 99%, about 25% to 99%, about 30% to 99%, about 35% to 99%, about 40% to 99%, about 45% to 99%, about 50% to 99%, about 55% to 99%, about 60% to 99%, about 65% to 99%, about 70% to 99%, about 80% to 99%, about 85% to 99%, about 90% to 99%, or about 95% to 99% of cytidine residues in the polyribonucleotide comprise N4-acetylcytidine.

Embodiment 110. The polyribonucleotide of any one of embodiments 106-108, wherein the polyribonucleotide comprises cytidine residues and wherein at least about 5%, at least about 10%, at least about 15%, at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, or at least about 99% of cytidine residues in the polyribonucleotide comprise N4-acetylcytidine.

Embodiment 111. The polyribonucleotide of embodiment 106, wherein the polyribonucleotide comprises cytidine residues and wherein more than 60% of cytidine residues in the polyribonucleotide comprise N4-acetylcytidine.

Embodiment 112. The polyribonucleotide of embodiment 111, wherein about 60-100%, about 65%-100%, about 70%-100%, about 75%-100%, about 80%-100%, about 85%-100%, about 90%-100%, about 95%-100%, about 60%-95%, about 60%-90%, about 60%-85%, about 60%-80%, about 60%-75%, about 60%-70%, about 60%-65% of cytidine residues in the polyribonucleotide comprise N4-acetylcytidine.

Embodiment 113. The polyribonucleotide of embodiment 111 or 112, wherein at least about 75% of cytidine residues in the polyribonucleotide comprise N4-acetylcytidine.

Embodiment 114. The polyribonucleotide of embodiment 111 or 112, wherein 100% of cytidine residues in the polyribonucleotide comprise N4-acetylcytidine.

Embodiment 115. A polyribonucleotide comprising one or more modified ribonucleotides, wherein the one or more modified ribonucleotides comprises one, or both of:

(i) 5-hydroxymethyluridine and the modified ribonucleotide has: (a) a 5' monophosphate; (b) a 5' diphosphate; or (c) a 5' triphosphate and a structure of:

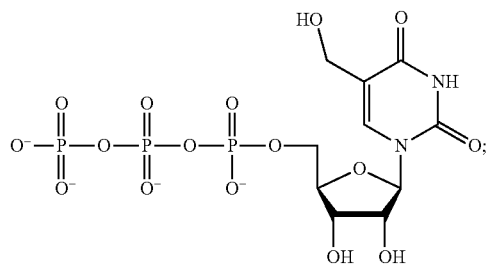

and (ii) N4-acetylcytidine and the modified ribonucleotide has: (a) a 5' monophosphate; (b) a 5' diphosphate; or (c) a 5' triphosphate and a structure of:

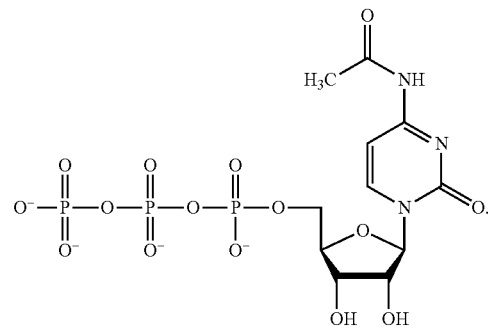

Embodiment 116. The polyribonucleotide of embodiment 115, wherein: (a) the polyribonucleotide comprises cytidine residues and at least 5% of cytidine residues in the polyribonucleotide comprise N4-acetylcytidine; and/or (b) the polyribonucleotide comprises uridine residues at least 5% of uridine residues in the polyribonucleotide comprise 5-hydroxymethyluridine.

Embodiment 117. The polyribonucleotide of embodiment 115, wherein (a) the polyribonucleotide comprises cytidine residues and less than 100% of cytidine residues in the polyribonucleotide comprise N4-acetylcytidine; and/or (b) the polyribonucleotide comprises uridine residues less than 100% of uridine residues in the polyribonucleotide comprise 5-hydroxymethyluridine.

Embodiment 118. The polyribonucleotide of any one of embodiments 115-117, wherein (a) the polyribonucleotide comprises cytidine residues and wherein about 5% to 99%, about 5% to 95%, about 5% to 90%, about 5% to 85%, about 5% to 80%, about 5% to 75%, about 5% to 70%, about 5% to 65%, about 5% to 60%, about 5% to 55%, about 5% to 50%, about 5% to 45%, about 5% to 40%, about 5% to 35%, about 5% to 30%, about 5% to 25%, about 5% to 20%, about 5% to 15%, about 5% to 10%, about 10% to 99%, about 15% to 99%, about 20% to 99%, about 25% to 99%, about 30% to 99%, about 35% to 99%, about 40% to 99%, about 45% to 99%, about 50% to 99%, about 55% to 99%, about 60% to 99%, about 65% to 99%, about 70% to 99%, about 80% to 99%, about 85% to 99%, about 90% to 99%, or about 95% to 99% of cytidine residues in the polyribonucleotide comprise N4-acetylcytidine; and/or (b) the polyribonucleotide comprises uridine residues and wherein about 5% to 99%, about 5% to 95%, about 5% to 90%, about 5% to 85%, about 5% to 80%, about 5% to 75%, about 5% to 70%, about 5% to 65%, about 5% to 60%, about 5% to 55%, about 5% to 50%, about 5% to 45%, about 5% to 40%, about 5% to 35%, about 5% to 30%, about 5% to 25%, about 5% to 20%, about 5% to 15%, about 5% to 10%, about 10% to 99%, about 15% to 99%, about 20% to 99%, about 25% to 99%, about 30% to 99%, about 35% to 99%, about 40% to 99%, about 45% to 99%, about 50% to 99%, about 55% to 99%, about 60% to 99%, about 65% to 99%, about 70% to 99%, about 80% to 99%, about 85% to 99%, about 90% to 99%, or about 95% to 99% of uridine residues in the polyribonucleotide comprise 5-hydroxymethyluridine.

Embodiment 119. The polyribonucleotide of any one of embodiments 115-118, wherein: (a) the polyribonucleotide comprises cytidine residues and wherein at least about 5%, at least about 10%, at least about 15%, at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, or at least about 99% of cytidine residues in the polyribonucleotide comprise N4-acetylcytidine; and/or (b) the polyribonucleotide comprises uridine residues and wherein at least about 5%, at least about 10%, at least about 15%, at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, or at least about 99% of uridine residues in the polyribonucleotide comprise 5-hydroxymethyluridine.

Embodiment 120. The polyribonucleotide of embodiment 115, wherein: (a) the polyribonucleotide comprises cytidine residues and wherein more than 60% of cytidine residues in the polyribonucleotide comprise N4-acetylcytidine; and/or (b) the polyribonucleotide comprises uridine residues and wherein more than 60% of uridine residues in the polyribonucleotide comprise 5-hydroxymethyluridine.

Embodiment 121. The polyribonucleotide of any one of embodiments 115 or 120, wherein: (a) about 60-100%, about 65%-100%, about 70%-100%, about 75%-100%, about 80%-100%, about 85%-100%, about 90%-100%, about 95%-100%, about 60%-95%, about 60%-90%, about 60%-85%, about 60%-80%, about 60%-75%, about 60%-70%, about 60%-65% of cytidine residues in the polyribonucleotide comprise N4-acetylcytidine; and/or (b) about 60-100%, about 65%-100%, about 70%-100%, about 75%-100%, about 80%-100%, about 85%-100%, about 90%-100%, about 95%-100%, about 60%-95%, about 60%-90%, about 60%-85%, about 60%-80%, about 60%-75%, about 60%-70%, about 60%-65% of uridine residues in the polyribonucleotide comprise 5-hydroxymethyluridine.

Embodiment 122. The polyribonucleotide of any one of embodiments 115 or 120-121, wherein (a) at least about 75% of cytidine residues in the polyribonucleotide comprise N4-acetylcytidine; and/or (b) at least about 75% of uridine residues in the polyribonucleotide comprise 5-hydroxymethyluridine.

Embodiment 123. The polyribonucleotide of any one of embodiments 115, or 120-121, wherein (a) 100% of cytidine residues in the polyribonucleotide comprise N4-acetylcytidine; and/or (b) 100% of uridine residues in the polyribonucleotide comprise 5-hydroxymethyluridine.

Embodiment 124. The polyribonucleotide of any one of embodiments 94-123, characterized in that when assessed in a cell, tissue, or organism that has been administered the polyribonucleotide, reduced immunogenicity is observed relative to an appropriate reference comparator.

Embodiment 125. The polyribonucleotide of embodiment 124, wherein a reference comparator comprises an otherwise similar cell, tissue or organism that has been administered a comparable polyribonucleotide that includes: (i) fewer N4-acetylcytidine nucleosides (e.g., does not include any N4-acetylcytidine nucleosides); and/or (ii) fewer 5-hydroxymethyluridine nucleosides (e.g., does not include any 5-hydroxymethyluridine nucleosides).

Embodiment 126. The polyribonucleotide of embodiment 124 or 125, wherein reduced immunogenicity comprises reduced activation of an innate immune response induced toxicity.

Embodiment 127. The polyribonucleotide of embodiment 126, wherein reduced activation of an immune response comprises reduced activation of pathways of NFkb, IRF, and/or other cytokines resulting from inflammation in the cell, tissue or organism.

Embodiment 128. The polyribonucleotide of embodiment 126 or 127, wherein reduced activation of an immune response comprises reduced detection of uncapped RNA by a molecular sensor.

Embodiment 129. The polyribonucleotide of embodiment 128, wherein the molecular sensor is or comprises RIG-I.

Embodiment 130. The polyribonucleotide of any one of embodiments 124-129, wherein reduced immunogenicity allows for repeated dosing of the polyribonucleotide.

Embodiment 131. The polyribonucleotide of any one of embodiments 124-130, wherein reduced immunogenicity allows for administration of a higher dose of the polyribonucleotide as compared to an appropriate reference comparator.

Embodiment 132. The polyribonucleotide of embodiment 131, wherein the reference comparator comprise a comparable polyribonucleotide that includes: (i) fewer N4-acetylcytidine nucleosides (e.g., does not include any N4-acetylcytidine nucleosides); and/or (ii) fewer 5-hydroxymethyluridine nucleosides (e.g., does not include any 5-hydroxymethyluridine nucleosides).

Embodiment 133. The polyribonucleotide of any one of embodiments 94-132, characterized in that when assessed in a cell, tissue or an organism that has been administered the polyribonucleotide, increased cell viability is observed relative to an appropriate reference comparator.

Embodiment 134. The polyribonucleotide of embodiment 133, wherein a reference comparator is the cell viability of a cell, tissue or organism that has been administered a comparable polyribonucleotide that includes: (i) fewer N4-acetylcytidine nucleosides (e.g., does not include any N4-acetylcytidine nucleosides); and/or (ii) fewer 5-hydroxymethyluridine nucleosides (e.g., does not include any 5-hydroxymethyluridine nucleosides).

Embodiment 135. The polyribonucleotide of embodiment 133 or 134, wherein cell viability is a measure of the length of time one or more cells of the cell, tissue or subject live.

Embodiment 136. The polyribonucleotide of any one of embodiments 133-135, wherein cell viability is a measure of a number of cells of the cell, tissue or subject alive at one or more time points.

Embodiment 137. The polyribonucleotide of any one of embodiments 94-136, characterized in that when assessed in a cell, tissue, or organism that has been administered the polyribonucleotide, increased expression of a payload is observed relative to an appropriate reference comparator.

Embodiment 138. The polyribonucleotide of embodiment 137, wherein a reference comparator comprises an otherwise similar cell, tissue or organism that has been administered a comparable polyribonucleotide that includes: (i) fewer N4-acetylcytidine nucleosides (e.g., does not include any N4-acetylcytidine nucleosides); and/or (ii) fewer 5-hydroxymethyluridine nucleosides (e.g., does not include any 5-hydroxymethyluridine nucleosides).

Embodiment 139. The polyribonucleotide of embodiment 137 or 138, wherein the increase in expression of the payload is about 1.2-fold, about 1.5-fold, about 2-fold, about 4-fold, about 5-fold, about 10-fold or about 20-fold compared to the reference comparator.

Embodiment 140. The polyribonucleotide of any one of embodiments 137-139, wherein the payload is or comprises a polypeptide encoded by the polyribonucleotide comprising one or more modified ribonucleotides.

Embodiment 141. The polyribonucleotide of any one of embodiments 137-140, wherein the payload is or comprises a polyribonucleotide situated in the polyribonucleotide comprising one or more modified ribonucleotides.

Embodiment 142. The polyribonucleotide of any one of embodiments 2-31 or 94-141, wherein the polyribonucleotide is or comprises an RNA oligo.

Embodiment 143. The polyribonucleotide of any one of embodiments 2-31 or 94-141, wherein the polyribonucleotide is or comprises a messenger RNA (mRNA).

Embodiment 144. The polyribonucleotide of any one of embodiments 2-31 or 94-141, wherein the polyribonucleotide is or comprises a gRNA.

Embodiment 145. The polyribonucleotide of any one of embodiments 2-31 or 94-141, wherein the polyribonucleotide is or comprises an inhibitory RNA.

Embodiment 146. The polyribonucleotide of any one of embodiments 2-31 or 94-141, wherein the polyribonucleotide is or comprises an miRNA or siRNA.

Embodiment 147. The polyribonucleotide of any one of embodiments 2-31 or 94-141, wherein the polyribonucleotide is or comprises an antisense oligonucleotide.

Embodiment 148. A composition comprising one or more polyribonucleotides of any one of embodiments 94-147.

Embodiment 149. The composition of embodiment 148, wherein the composition is a pharmaceutical composition.

Embodiment 150. The composition of embodiment 149, wherein the pharmaceutical composition is or comprises an immunogenic composition.

Embodiment 151. The composition of embodiment 149, wherein the pharmaceutical composition is or comprises a vaccine.

Embodiment 152. The composition of embodiment 149, wherein the pharmaceutical composition is or comprises a gene therapy.

Embodiment 153. The composition of embodiment 149, wherein the pharmaceutical composition is or comprises a chemotherapy.

Embodiment 154. The composition of embodiment 149, wherein the pharmaceutical composition is or comprises a protein replacement therapy.

Embodiment 155. The composition of embodiment 149, wherein the pharmaceutical composition is or comprises an immunotherapy, an antibody therapy, and/or an immune-modulation therapy.

Embodiment 156. The composition of embodiment 149, wherein the pharmaceutical composition is or comprises a cell engineering therapy.

Embodiment 157. The composition of any one of embodiments 149-156, wherein the composition comprises double stranded RNA.

Embodiment 158. A method comprising administering one or more polyribonucleotides according to any one of embodiments 94-147, or a composition according to any one of embodiments 148-157 to a cell, tissue or subject.

Embodiment 159. The method of embodiment 158, further comprising determining cell viability of the cell, tissue or subject.

Embodiment 160. The method of embodiment 158, wherein cell viability is a measure of the length of time one or more cells of the cell, tissue or subject live.

Embodiment 161. The method of embodiment 158, wherein cell viability is a measure of a number of cells of the cell, tissue or subject alive at one or more time points.

Embodiment 162. The method of any one of embodiments 158-161, wherein the cell, tissue or subject to which the polyribonucleotide or a composition comprising the same has been administered exhibits improved cell viability as compared to a reference cell viability.

Embodiment 163. The method of embodiment 162, wherein the reference cell viability is the cell viability of a cell, tissue or subject that has been administered a comparable polyribonucleotide or a composition comprising the same that includes fewer: (i) N4-acetylcytidine nucleosides (e.g., does not include any N4-acetylcytidine nucleosides); and/or (ii) fewer 5-hydroxymethyluridine nucleosides (e.g., does not include any 5-hydroxymethyluridine nucleosides).

Embodiment 164. The method of any one of embodiments 158-163, further comprising determining an immune system response of the cell, tissue or subject to which the polyribonucleotide or a composition comprising the same has been administered.

Embodiment 165. The method of embodiment 164, wherein the immune response comprises an innate immune system response comprising innate immune system induced toxicity.

Embodiment 166. The method of embodiment 165, wherein determining an innate immune system response comprises determining a level of NF-κB, IRF, and/or other inflammatory cytokines in the cell, tissue or subject.

Embodiment 167. The method of embodiment 166, wherein determining an innate immune system response comprises determining a level of uncapped RNA detected by a molecular sensor.

Embodiment 168. The method of embodiment 167, wherein the molecular sensor is or comprises RIG-I.

Embodiment 169. The method of any one of embodiments 164-168, wherein the cell, tissue or subject to which the polyribonucleotide or a composition comprising the same has been administered exhibits a reduced innate immune system response as compared to a reference.

Embodiment 170. The method of any one of embodiments 158-169, wherein the reference is an innate immune system response of a cell, tissue or subject that has been administered a comparable polyribonucleotide or a composition comprising the same that includes fewer: (i) N4-acetylcytidine nucleosides (e.g., does not include any N4-acetylcytidine nucleosides); and/or (ii) fewer 5-hydroxymethyluridine nucleosides (e.g., does not include any 5-hydroxymethyluridine nucleosides).

Embodiment 171. The method of any one of embodiments 32-78 or 158-170, further comprising determining expression of a payload in the cell, tissue or subject to which the polyribonucleotide or a composition comprising the same has been administered.

Embodiment 172. The method of embodiment 171, wherein the payload is or comprises a polypeptide encoded by the polyribonucleotide comprising one or more modified ribonucleotides.

Embodiment 173. The method of embodiment 171, wherein the payload is or comprises a polyribonucleotide situated in the polyribonucleotide comprising one or more modified ribonucleotides.

Embodiment 174. The method of any one of embodiments 171-173, wherein determining expression of a payload comprises determining expression of an RNA, or a polypeptide, or both.

Embodiment 175. The method of any one of embodiments 171-174, wherein the cell, tissue or subject to which the polyribonucleotide or a composition comprising the same has been administered exhibits increased expression of the payload as compared to a reference.

Embodiment 176. The method of any one of embodiments 171-175, wherein the reference is expression of the payload in a cell, tissue or subject that has been administered a comparable polyribonucleotide or a composition comprising the same that includes fewer: (i) N4-acetylcytidine nucleosides (e.g., does not include any N4-acetylcytidine nucleosides); and/or (ii) fewer 5-hydroxymethyluridine nucleosides (e.g., does not include any 5-hydroxymethyluridine nucleosides).

Embodiment 177. The method of any one of embodiments 171-176, wherein the increase in expression of the payload is about 1.2-fold, about 1.5-fold, about 2-fold, about 4-fold, about 5-fold, about 10-fold or about 20-fold compared to the reference.

Embodiment 178. The method of any one of embodiments 158-177, wherein the method comprises administering the polyribonucleotide or a composition comprising the same to the cell, tissue or subject at least two times.

Embodiment 179. The method of any one of embodiments 158-178, wherein the method comprises administering the polyribonucleotide or a composition comprising the same to the cell, tissue or subject 2 times, 3 times, 4 times, 5 times, 6 times, 7 times, 8 times, 9 times or 10 times.

Embodiment 180. The method of embodiment 178 or 179, wherein at least two administrations of the polyribonucleotide or a composition comprising the same to the cell, tissue or subject does not result in reduced efficacy of the polyribonucleotide or a composition comprising the same compared to administration of one dose of the polyribonucleotide or a composition comprising the same.

Embodiment 181. The method of any one of embodiments 158-180, wherein the method comprises administering the polyribonucleotide or a composition comprising the same to the cell, tissue or subject at a higher dose compared to an appropriate reference comparator.

Embodiment 182. The method of embodiment 181, wherein the reference comparator comprise a comparable polyribonucleotide that includes: (i) fewer N4-acetylcytidine nucleosides (e.g., does not include any N4-acetylcytidine nucleosides); and/or (ii) fewer 5-hydroxymethyluridine nucleosides (e.g., does not include any 5-hydroxymethyluridine nucleosides).

Embodiment 183. The method of any one of embodiments 158-182, wherein the cell is a mammalian cell, the tissue is a mammalian tissue, or the subject is a mammal.

Embodiment 184. The method of embodiment 182, wherein the mammal is a human.

Embodiment 185. The method of any one of embodiments 158-184, wherein the method is a method to stimulate an immune response.

Embodiment 186. The method of any one of embodiments 158-185, wherein the method is a vaccination method.

Embodiment 187. The method of any one of embodiments 158-185, wherein the method is a gene therapy method.

Embodiment 188. The method of embodiment 187, wherein the gene therapy method comprises delivery of one or more components of a gene therapy such as a gRNA.

Embodiment 189. The method of any one of embodiments 158-185, wherein the method is a cell therapy engineering method.

Embodiment 190. The method of any one of embodiments 158-185, wherein the method is an immunotherapy method or an antibody therapy method.

Embodiment 191. The method of embodiment 190, wherein the immunotherapy method comprises delivery of an immune-modulation therapy, and/or an immune checkpoint therapy.

Embodiment 192. The method of any one of embodiments 158-184, wherein the method is a protein replacement therapy method.

Embodiment 193. The method of embodiment 192, wherein the protein replacement therapy method comprises delivery of an enzyme replacement therapy.

Embodiment 194. The method of any one of embodiments 158-185, wherein the method is a chemotherapeutic method.

Embodiment 195. A method of vaccination comprising administering one or more polyribonucleotides according to any one of embodiments 94-147, or a composition according to any one of embodiments 148-157 to a cell, tissue or subject.

Embodiment 196. A method of immunotherapy comprising administering one or more polyribonucleotides according to any one of embodiments 94-147, or a composition according to any one of embodiments 148-157 to a cell, tissue or subject.

Embodiment 197. A method of gene therapy comprising administering one or more polyribonucleotides according to any one of embodiments 94-147, or a composition according to any one of embodiments 148-157 to a cell, tissue or subject.

Embodiment 198. A method of protein replacement therapy, comprising administering one or more polyribonucleotides according to any one of embodiments 94-147, or a composition according to any one of embodiments 148-157 to a cell, tissue or subject.

Embodiment 199. A method of cell engineering therapy, comprising administering one or more polyribonucleotides according to any one of embodiments 94-147, or a composition according to any one of embodiments 148-157 to a cell, tissue or subject.

Embodiment 200. A method of obtaining a lower level of immunogenicity in a subject who has received a polyribonucleotide according to any one of embodiments 2-31 or 94-147, or a composition according to any one of embodiments 32-41 or 148-157, as compared with a subject who has received a comparable unmodified polyribonucleotide, the method comprising administering the polyribonucleotide or a composition comprising the polynucleotide to the subject.

Embodiment 201. The method of embodiment 200, wherein the polyribonucleotide according to any one of embodiments 2-31 or 94-147, or a composition according to any one of embodiments 32-41 or 148-157, does not comprise a 5' cap, e.g., a 5'-5' triphosphate linked guanosine.

Embodiment 202. The method of embodiment 200 or 201, wherein the polyribonucleotide according to any one of embodiments 2-31 or 94-147, or a composition according to any one of embodiments 32-41 or 148-157, comprises a 5' phosphate and/or a hydroxyl group at the 5' terminus of the polyribonucleotide.

Embodiment 203. The method of any one of embodiments 200-202, wherein the subject who has received a polyribonucleotide according to any one of embodiments 2-31 or 94-147, or a composition according to any one of embodiments 32-41 or 148-157, and the subject who has received a comparable unmodified polyribonucleotide are the same subject.

Embodiment 204. The method of any one of embodiments 200-202, wherein the subject who has received a polyribonucleotide according to any one of embodiments 2-31 or 94-147, or a composition according to any one of embodiments 32-41 or 148-157, and the subject who has received a comparable unmodified polyribonucleotide are different subjects.

Embodiment 205. A method of manufacturing an RNA composition comprising introducing at least one modified ribonucleotide according to embodiment 93 or 115 into a polyribonucleotide.

Embodiment 206. The method of embodiment 205, wherein the polyribonucleotide further comprises one or more modified ribonucleotides other than 5-hydroxymethyluridine according to any one of embodiments 103-106.

Embodiment 207. The method of embodiment 205 or 206, wherein the method does not comprise removing double-stranded RNA from the RNA composition.

Embodiment 208. A cell comprising a polyribonucleotide according to any one of embodiments 94-147, or a composition according to any one of embodiments 148-157.

Embodiment 209. Use of a modified ribonucleotide according to embodiment 93 or 115 in the production of a polyribonucleotide.

Embodiment 210. The use of embodiment 209, wherein the polyribonucleotide further comprises one or more modified ribonucleotides other than 5-hydroxymethyluridine.

Embodiment 211. Use of a polyribonucleotide according to any one of embodiments 94-147, or a composition according to any one of embodiments 148-157, to stimulate an immune response.

Embodiment 212. Use of a polyribonucleotide according to any one of embodiments 94-147, or a composition according to any one of embodiments 148-157, as a vaccine.

Embodiment 213. Use of a polyribonucleotide according to any one of embodiments 94-147, or a composition according to any one of embodiments 148-157, as an immunotherapy, e.g., an immune-modulation therapy, and/or an immune checkpoint therapy; or an antibody therapy.

Embodiment 214. Use of a polyribonucleotide according to any one of embodiments 94-147, or a composition according to any one of embodiments 148-157, as a gene therapy.

Embodiment 215. Use of a polyribonucleotide according to any one of embodiments 94-147, or a composition according to any one of embodiments 148-157, as a protein replacement therapy.

Embodiment 216. Use of a polyribonucleotide according to any one of embodiments 94-147, or a composition according to any one of embodiments 148-157, as a cell engineering therapy.

Embodiment 217. Use of a polyribonucleotide according to any one of embodiments 94-147, or a composition according to any one of embodiments 148-157, as a chemotherapy.

Embodiment 218. The use of any one of embodiments 200-217, wherein the polyribonucleotide or a composition comprising the same is administered to a cell, tissue or subject.

Embodiment 219. The use of embodiment 218, wherein the cell is a mammalian cell, the tissue is a mammalian tissue, or the subject is a mammal.

Embodiment 220. The use of embodiment 219, wherein the mammal is a human.

EQUIVALENTS

Those skilled in the art will recognize, or be able to ascertain using no more than routine experimentation, many equivalents to the specific embodiments of the invention described herein. It is to be understood that the invention encompasses all variations, combinations, and permutations in which one or more limitations, elements, clauses, descriptive terms, etc., from one or more of the listed claims is introduced into another claim dependent on the same base claim (or, as relevant, any other claim) unless otherwise indicated or unless it would be evident to one of ordinary skill in the art that a contradiction or inconsistency would arise. Further, it should also be understood that any embodiment or aspect of the invention can be explicitly excluded from the claims, regardless of whether the specific exclusion is recited in the specification. The scope of the present invention is not intended to be limited to the above Description, but rather is as set forth in the claims that follow.

SEQUENCE LISTING (1421 sequences)

SEQ ID NO: 1 - DNA, 12 bp, synthetic construct
  source 1..12: mol_type = other DNA
agctagctagct

SEQ ID NO: 2 - DNA, 10 bp, synthetic construct
  source 1..10: mol_type = other DNA
gctagctagc

SEQ ID NO: 3 - DNA, 316 bp, synthetic construct
  source 1..316: mol_type = other DNA
ctcaaggaacaacattgccaaaaggcttctacgcagaagggagcagaggcggcagtcaagcctcttctcgttcctcatcacgtagtcgcaacagttcaagaaattcaactccaggcagcagtaggggaacttctcctgctagaatggctggcaatggcggtgatgctgctcttgctttgctgctgcttgacagattgaaccagcttgagagcaaaatgtctggtaaaggccaacaacaacaaggccaaactgtcactaagaaatctgctgctgaggcttctaagaagcctcggcaaaaacgtactgccactaaagc

SEQ ID NO: 4 - DNA, 19 bp, synthetic construct
  source 1..19: mol_type = other DNA
gtttggccttgttgttgtt

SEQ ID NO: 5 - RNA, 44 nt, synthetic construct
  source 1..44: mol_type = other RNA
taatttctactaagtgtagatttgaactgttgcgactacgtgat

SEQ ID NO: 6 - DNA, 21 bp, synthetic construct
  source 1..21: mol_type = other DNA
  modified_base 3: mod_base = OTHER; note = Thymine phosphorothioate
  modified_base 5: mod_base = OTHER; note = Thymine phosphorothioate
  modified_base 7: mod_base = OTHER; note = Adenine phosphorothioate
  modified_base 9: mod_base = OTHER; note = Adenine phosphorothioate
  modified_base 11: mod_base = OTHER; note = Guanosine phosphorothioate
  modified_base 13: mod_base = OTHER; note = Cytosine phosphorothioate
  modified_base 15: mod_base = OTHER; note = Thymine phosphorothioate
  modified_base 17: mod_base = OTHER; note = Thymine phosphorothioate
gttattaaatgacttctcatt

SEQ ID NO: 7 - DNA, 2007 bp, Staphylococcus aureus
  source 1..2007: mol_type = genomic DNA
atgaaaaagataaaaattgttccacttattttaatagttgtagttgtcgggtttggtatatatttttatgcttcaaaagataaagaaattaataatactattgatgcaattgaagataaaaatttcaaacaagtttataaagatagcagttatatttctaaaagcgataatggtgaagtagaaatgactgaacgtccgataaaaatatataatagtttaggcgttaaagatataaacattcaggatcgtaaaataaaaaaagtatctaaaaataaaaaacgagtagatgctcaatataaaattaaaacaaactacggtaacattgatcgcaacgttcaatttaattttgttaaagaagatggtatgtggaagttagattgggatcatagcgtcattattccaggaatgcagaaagaccaaagcatacatattgaaaatttaaaatcagaacgtggtaaaattttagaccgaaacaatgtggaattggccaatacaggaacagcatatgagataggcatcgttccaaagaatgtatctaaaaaagattataaagcaatcgctaaagaactaagtatttctgaagactatatcaaacaacaaatggatcaaaattgggtacaagatgataccttcgttccacttaaaaccgttaaaaaaatggatgaatatttaagtgatttcgcaaaaaaatttcatcttacaactaatgaaacagaaagtcgtaactatcctctaggaaaagcgacttcacatctattaggttatgttggtcccattaactctgaagaattaaaacaaaaagaatataaaggctataaagatgatgcagttattggtaaaaagggactcgaaaaactttacgataaaaagctccaacatgaagatggctatcgtgtcacaatcgttgacgataatagcaatacaatcgcacatacattaatagagaaaaagaaaaaagatggcaaagatattcaactaactattgatgctaaagttcaaaagagtatttataacaacatgaaaaatgattatggctcaggtactgctatccaccctcaaacaggtgaattattagcacttgtaagcacaccttcatatgacgtctatccatttatgtatggcatgagtaacgaagaatataataaattaaccgaagataaaaaagaacctctgctcaacaagttccagattacaacttcaccaggttcaactcaaaaaatattaacagcaatgattgggttaaataacaaaacattagacgataaaacaagttataaaatcgatggtaaaggttggcaaaaagataaatcttggggtggttacaacgttacaagatatgaagtggtaaatggtaatatcgacttaaaacaagcaatagaatcatcagataacattttctttgctagagtagcactcgaattaggcagtaagaaatttgaaaaaggcatgaaaaaactaggtgttggtgaagatataccaagtgattatccattttataatgctcaaatttcaaacaaaaatttagataatgaaatattattagctgattcaggttacggacaaggtgaaatactgattaacccagtacagatcctttcaatctatagcgcattagaaaataatggcaatattaacgcacctcacttattaaaagacacgaaaaacaaagtttggaagaaaaatattatttccaaagaaaatatcaatctattaactgatggtatgcaacaagtcgtaaataaaacacataaagaagatatttatagatcttatgcaaacttaattggcaaatccggtactgcagaactcaaaatgaaacaaggagaaactggcagacaaattgggtggtttatatcatatgataaagataatccaaacatgatgatggctattaatgttaaagatgtacaagataaaggaatggctagctacaatgccaaaatctcaggtaaagtgtatgatgagctatatgagaacggtaataaaaaatacgatatagatgaataa

SEQ ID NO: 8 - DNA, 20 bp, synthetic construct
  source 1..20: mol_type = other DNA
tgtatggcatgagtaacgaa

SEQ ID NO: 9 - DNA, 79 bp, synthetic construct
  source 1..79: mol_type = other DNA
gttattgagaattattgtcatattattctaatattattaaggcttattcactgttattattataattattaagcttatt

SEQ ID NO: 10 - DNA, 74 bp, synthetic construct
  source 1..74: mol_type = other DNA
gttattgagaagttattatcatctattattaataagttattgccactattattgttataattattaagcttatt

SEQ ID NO: 11 - DNA, 68 bp, synthetic construct
  source 1..68: mol_type = other DNA
gttattgagaagtattattcatctaattattataaggccttattactgttattattaataagcttatt

SEQ ID NO: 12 - DNA, 63 bp, synthetic construct
  source 1..63: mol_type = other DNA
gttattgagaagtcttattatctaatattattaggccactgttattattataataagcttatt

SEQ ID NO: 13 - DNA, 64 bp, synthetic construct
  source 1..64: mol_type = other DNA
gttattgagaagtcattattatctaataagttattgccactgttattattataataagcttatt

SEQ ID NO: 14 - DNA, 62 bp, synthetic construct
  source 1..62: mol_type = other DNA
gatactttttattttttatatatatatatattttttatttttatatatatatatatagtatc

SEQ ID NO: 15 - DNA, 62 bp, synthetic construct
  source 1..62: mol_type = other DNA
gacactttttattttttatatatatatatattttttatttttatatatatatatatagtgtc

SEQ ID NO: 16 - DNA, 62 bp, synthetic construct
  source 1..62: mol_type = other DNA
gatactttttatttttgatatatatatatattttttatttttatatatatatatatcgtatc

SEQ ID NO: 17 - DNA, 62 bp, synthetic construct
  source 1..62: mol_type = other DNA
ggatctttttattttttatatatatatatattttttatttttatatatatatatatagatcc

SEQ ID NO: 18 - DNA, 62 bp, synthetic construct
  source 1..62: mol_type = other DNA
gacactttttatttttgatatatatatatattttttatttttatatatatatatatcgtgtc

SEQ ID NO: 19 - DNA, 62 bp, synthetic construct
  source 1..62: mol_type = other DNA
ggatctttttatttttgatatatatatatattttttatttttatatatatatatatcgatcc

SEQ ID NO: 20 - DNA, 62 bp, synthetic construct
  source 1..62: mol_type = other DNA
gcgtctttttattttttatatatatatatattttttatttttatatatatatatatagacgc

SEQ ID NO: 21 - DNA, 62 bp, synthetic construct
  source 1..62: mol_type = other DNA
gcgtctttttatttttgatatatatatatattttttatttttatatatatatatatcgacgc

SEQ ID NO: 22 - DNA, 62 bp, synthetic construct
  source 1..62: mol_type = other DNA
gtatactttttattttttatatatatatatatttttattttttatatatatatatagtatac

SEQ ID NO: 23 - DNA, 62 bp, synthetic construct
  source 1..62: mol_type = other DNA
gtgatctttttattttttatatatatatatatttttattttttatatatatatatagatcac

SEQ ID NO: 24 - DNA, 62 bp, synthetic construct
  source 1..62: mol_type = other DNA
gtatactttttatttttgatatatatatatatttttattttttatatatatatatcgtatac

SEQ ID NO: 25 - DNA, 62 bp, synthetic construct
  source 1..62: mol_type = other DNA
gtatactttttatttttgatatatgtatatatttttattttttatatacatatatcgtatac

SEQ ID NO: 26 - DNA, 62 bp, synthetic construct
  source 1..62: mol_type = other DNA
ggatactttttattttttatatatatatatatttttattttttatatatatatatagtatcc

SEQ ID NO: 27 - DNA, 62 bp, synthetic construct
  source 1..62: mol_type = other DNA
gtgatctttttatttttgatatatatatatatttttattttttatatatatatatcgatcac

SEQ ID NO: 28 - DNA, 62 bp, synthetic construct
  source 1..62: mol_type = other DNA
gtgatctttttatttttgatatatgtatatatttttattttttatatacatatatcgatcac

SEQ ID NO: 29 - DNA, 62 bp, synthetic construct
  source 1..62: mol_type = other DNA
ggatactttttatttttgatatatatatatatttttattttttatatatatatatcgtatcc

SEQ ID NO: 30 - DNA, 62 bp, synthetic construct
  source 1..62: mol_type = other DNA
ggatactttttatttttgatatatgtatatatttttattttttatatacatatatcgtatcc

SEQ ID NO: 31 - DNA, 62 bp, synthetic construct
  source 1..62: mol_type = other DNA
gcgatctttttattttttatatatatatatatttttattttttatatatatatatagatcgc

SEQ ID NO: 32 - DNA, 62 bp, synthetic construct
  source 1..62: mol_type = other DNA
gcgatctttttatttttgatatatatatatatttttattttttatatatatatatcgatcgc

SEQ ID NO: 33 - DNA, 62 bp, synthetic construct
  source 1..62: mol_type = other DNA
gcgatctttttatttttgatatatgtatatatttttattttttatatacatatatcgatcgc

SEQ ID NO: 34 - DNA, 62 bp, synthetic construct
  source 1..62: mol_type = other DNA
gatatactttttattttttatatatatatattttttatttttatatatatatatagtatatc

SEQ ID NO: 35 - DNA, 62 bp, synthetic construct
  source 1..62: mol_type = other DNA
gatatattttttatttttgatatatatatattttttatttttatatatatatatcatatatc

SEQ ID NO: 36 - DNA, 62 bp, synthetic construct
  source 1..62: mol_type = other DNA
gatatattttttatttttgatatatgtatattttttatttttatatacatatatcatatatc

SEQ ID NO: 37 - DNA, 62 bp, synthetic construct
  source 1..62: mol_type = other DNA
gtgatactttttattttttatatatatatattttttatttttatatatatatatagtatcac

SEQ ID NO: 38 - DNA, 62 bp, synthetic construct
  source 1..62: mol_type = other DNA
gatatactttttatttttgatatatatatattttttatttttatatatatatatcgtatatc

SEQ ID NO: 39 - DNA, 62 bp, synthetic construct
  source 1..62: mol_type = other DNA
gatatactttttatttttgatatatgtatattttttatttttatatacatatatcgtatatc

SEQ ID NO: 40 - DNA, 62 bp, synthetic construct
  source 1..62: mol_type = other DNA
ggtatactttttattttttatatatatatattttttatttttatatatatatatagtatacc

SEQ ID NO: 41 - DNA, 62 bp, synthetic construct
  source 1..62: mol_type = other DNA
gtgatactttttatttttgatatatatatattttttatttttatatatatatatcgtatcac

SEQ ID NO: 42 - DNA, 62 bp, synthetic construct
  source 1..62: mol_type = other DNA
gtgatactttttatttttgatatatgtatattttttatttttatatacatatatcgtatcac

SEQ ID NO: 43 - DNA, 62 bp, synthetic construct
  source 1..62: mol_type = other DNA
ggtatactttttatttttgatatatatatattttttatttttatatatatatatcgtatacc

SEQ ID NO: 44 - DNA, 62 bp, synthetic construct
  source 1..62: mol_type = other DNA
ggtatactttttatttttgatatatgtatattttttatttttatatacatatatcgtatacc

SEQ ID NO: 45 - DNA, 62 bp, synthetic construct
  source 1..62: mol_type = other DNA
ggtgtactttttattttttatatatatatattttttatttttatatatatatatagtacacc

SEQ ID NO: 46 - DNA, 62 bp, synthetic construct
  source 1..62: mol_type = other DNA
ggtgtactttttatttttgatatatatatattttttatttttatatatatatatcgtacacc

SEQ ID NO: 47 - DNA, 62 bp, synthetic construct
  source 1..62: mol_type = other DNA
ggtgtactttttatttttgatatatgtatattttttatttttatatacatatatcgtacacc

SEQ ID NO: 48 - DNA, 62 bp, synthetic construct
  source 1..62: mol_type = other DNA
gtatatactttttattttttatatatatatatttttattttttatatatatatagtatatac

SEQ ID NO: 49 - DNA, 62 bp, synthetic construct
  source 1..62: mol_type = other DNA
gtatatactttttatttttgatatatatatatttttattttttatatatatatcgtatatac

SEQ ID NO: 50 - DNA, 62 bp, synthetic construct
  source 1..62: mol_type = other DNA
gtatatactttttatttttgatatatgtatatttttattttttatacatatatcgtatatac

SEQ ID NO: 51 - DNA, 62 bp, synthetic construct
  source 1..62: mol_type = other DNA
gtatatactttttatttttgatcatgtatattttttatttttatatacatgatcgtatatac

SEQ ID NO: 52 - DNA, 62 bp, synthetic construct
  source 1..62: mol_type = other DNA
gtatatactttttatttttgatcatatatgttttttatttttacatatatgatcgtatatac

SEQ ID NO: 53 - DNA, 62 bp, synthetic construct
  source 1..62: mol_type = other DNA
ggatatactttttattttttatatatatatatttttattttttatatatatatagtatatcc

SEQ ID NO: 54 - DNA, 62 bp, synthetic construct
  source 1..62: mol_type = other DNA
ggatatactttttatttttgatatatatatatttttattttttatatatatatcgtatatcc

SEQ ID NO: 55 - DNA, 62 bp, synthetic construct
  source 1..62: mol_type = other DNA
ggatatactttttatttttgatatatgtatatttttattttttatacatatatcgtatatcc

SEQ ID NO: 56 - DNA, 62 bp, synthetic construct
  source 1..62: mol_type = other DNA
ggatatactttttatttttgatcatgtatattttttatttttatatacatgatcgtatatcc

SEQ ID NO: 57 - DNA, 62 bp, synthetic construct
  source 1..62: mol_type = other DNA
ggatatactttttatttttgatcatatatgttttttatttttacatatatgatcgtatatcc

SEQ ID NO: 58 - DNA, 62 bp, synthetic construct
  source 1..62: mol_type = other DNA
ggtgatactttttattttttatatatatatatttttattttttatatatatatagtatcacc

SEQ ID NO: 59 - DNA, 62 bp, synthetic construct
  source 1..62: mol_type = other DNA
ggtgatactttttatttttgatatatatatatttttattttttatatatatatcgtatcacc

SEQ ID NO: 60 - DNA, 62 bp, synthetic construct
  source 1..62: mol_type = other DNA
ggtgatactttttatttttgatatatgtatatttttattttttatacatatatcgtatcacc

SEQ ID NO: 61 - DNA, 62 bp, synthetic construct
  source 1..62: mol_type = other DNA
ggtgatactttttatttttgatcatgtatattttttatttttatatacatgatcgtatcacc

SEQ ID NO: 62 - DNA, 62 bp, synthetic construct
  source 1..62: mol_type = other DNA
ggtgatactttttatttttgatcatatatgttttttatttttacatatatgatcgtatcacc

SEQ ID NO: 63 - DNA, 62 bp, synthetic construct
  source 1..62: mol_type = other DNA
ggtgatcctttttattttttatatatatatatttttattttttatatatatataggatcacc

SEQ ID NO: 64 - DNA, 62 bp, synthetic construct
  source 1..62: mol_type = other DNA
ggtgatcctttttatttttgatatatatatatttttattttttatatatatatcggatcacc

SEQ ID NO: 65 - DNA, 62 bp, synthetic construct
  source 1..62: mol_type = other DNA
ggtgatcctttttatttttgatatatgtatatttttattttttatacatatatcggatcacc

SEQ ID NO: 66 - DNA, 62 bp, synthetic construct
  source 1..62: mol_type = other DNA
ggtgatcctttttatttttgatcatgtatattttttatttttatatacatgatcggatcacc

SEQ ID NO: 67 - DNA, 62 bp, synthetic construct
  source 1..62: mol_type = other DNA
ggtgatcctttttatttttgatcatatatgttttttatttttacatatatgatcggatcacc

SEQ ID NO: 68 - DNA, 62 bp, synthetic construct
  source 1..62: mol_type = other DNA
gatatatcactttttattttttatatatatatttttattttttatatatatagtgatatatc

SEQ ID NO: 69 - DNA, 62 bp, synthetic construct
  source 1..62: mol_type = other DNA
gtatatacattttttatttttgatatatatatttttattttttatatatatcatgtatatac

SEQ ID NO: 70 - DNA, 62 bp, synthetic construct
  source 1..62: mol_type = other DNA
gtatatacattttttatttttgatatatgtatttttattttttacatatatcatgtatatac

SEQ ID NO: 71 - DNA, 62 bp, synthetic construct
  source 1..62: mol_type = other DNA
gtatatacattttttatttttgatcatgtattttttatttttatacatgatcatgtatatac

SEQ ID NO: 72 - DNA, 62 bp, synthetic construct
  source 1..62: mol_type = other DNA
gtatatacattttttatttttgatcatatattttttatttttatatatgatcatgtatatac

SEQ ID NO: 73 - DNA, 62 bp, synthetic construct
  source 1..62: mol_type = other DNA
ggatatacactttttattttttatatatatatttttattttttatatatatagtgtatatcc

SEQ ID NO: 74 - DNA, 62 bp, synthetic construct
  source 1..62: mol_type = other DNA
ggatatacattttttatttttgatatatatatttttattttttatatatatcatgtatatcc

SEQ ID NO: 75 - DNA, 62 bp, synthetic construct
  source 1..62: mol_type = other DNA
ggatatacattttttatttttgatatatgtatttttattttttacatatatcatgtatatcc

SEQ ID NO: 76 - DNA, 62 bp, synthetic construct
  source 1..62: mol_type = other DNA
ggatatacattttttatttttgatcatgtattttttatttttatacatgatcatgtatatcc

SEQ ID NO: 77 - DNA, 62 bp, synthetic construct
  source 1..62: mol_type = other DNA
ggatatacattttttatttttgatcatatattttttatttttatatatgatcatgtatatcc

SEQ ID NO: 78 - DNA, 62 bp, synthetic construct
  source 1..62: mol_type = other DNA
gggtatatactttttattttttatatatatatttttattttttatatatatagtatataccc

SEQ ID NO: 79 - DNA, 62 bp, synthetic construct
  source 1..62: mol_type = other DNA
ggatatacactttttatttttgatatatatatttttattttttatatatatcgtgtatatcc

SEQ ID NO: 80 - DNA, 62 bp, synthetic construct
  source 1..62: mol_type = other DNA
ggatatacactttttatttttgatatatgtatttttattttttacatatatcgtgtatatcc

SEQ ID NO: 81 - DNA, 62 bp, synthetic construct
  source 1..62: mol_type = other DNA
ggatatacactttttatttttgatcatgtattttttatttttatacatgatcgtgtatatcc

SEQ ID NO: 82 - DNA, 62 bp, synthetic construct
  source 1..62: mol_type = other DNA
ggatatacactttttatttttgatcatatattttttatttttatatatgatcgtgtatatcc

SEQ ID NO: 83 - DNA, 62 bp, synthetic construct
  source 1..62: mol_type = other DNA
gggtatatactttttatttttgatatatatatttttattttttatatatatcgtatataccc

SEQ ID NO: 84 - DNA, 62 bp, synthetic construct
  source 1..62: mol_type = other DNA
gggtatatactttttatttttgatatatgtatttttattttttacatatatcgtatataccc

SEQ ID NO: 85 - DNA, 62 bp, synthetic construct
  source 1..62: mol_type = other DNA
gggtatatactttttatttttgatcatgtattttttatttttatacatgatcgtatataccc

SEQ ID NO: 86 - DNA, 62 bp, synthetic construct
  source 1..62: mol_type = other DNA
gggtatatactttttatttttgatcatatattttttatttttatatatgatcgtatataccc

SEQ ID NO: 87 - DNA, 62 bp, synthetic construct
  source 1..62: mol_type = other DNA
ggatgtacactttttattttttatatatatatttttattttttatatatatagtgtacatcc

SEQ ID NO: 88 - DNA, 62 bp, synthetic construct
  source 1..62: mol_type = other DNA
ggatgtacactttttatttttgatatatatatttttattttttatatatatcgtgtacatcc

SEQ ID NO: 89 - DNA, 62 bp, synthetic construct
  source 1..62: mol_type = other DNA
ggatgtacactttttatttttgatatatgtatttttattttttacatatatcgtgtacatcc

SEQ ID NO: 90 - DNA, 62 bp, synthetic construct
  source 1..62: mol_type = other DNA
ggatgtacactttttatttttgatcatgtattttttatttttatacatgatcgtgtacatcc

SEQ ID NO: 91 - DNA, 62 bp, synthetic construct
  source 1..62: mol_type = other DNA
ggatgtacactttttatttttgatcatatattttttatttttatatatgatcgtgtacatcc

SEQ ID NO: 92 - DNA, 68 bp, synthetic construct
  source 1..68: mol_type = other DNA
gtatatactttttattttttatatatatatatattttttatttttatatatatatatatagtatatac

SEQ ID NO: 93 - DNA, 68 bp, synthetic construct
  source 1..68: mol_type = other DNA
gtatatactttttatttttgatatatatatatattttttatttttatatatatatatatcgtatatac

SEQ ID NO: 94 - DNA, 68 bp, synthetic construct
  source 1..68: mol_type = other DNA
ggatatactttttattttttatatatatatatattttttatttttatatatatatatatagtatatcc

SEQ ID NO: 95 - DNA, 68 bp, synthetic construct
  source 1..68: mol_type = other DNA
ggatatactttttatttttgatatatatatatattttttatttttatatatatatatatcgtatatcc

SEQ ID NO: 96 - DNA, 68 bp, synthetic construct
  source 1..68: mol_type = other DNA
ggtgatactttttattttttatatatatatatattttttatttttatatatatatatatagtatcacc

SEQ ID NO: 97 - DNA, 68 bp, synthetic construct
  source 1..68: mol_type = other DNA
ggtgatactttttatttttgatatatatatatattttttatttttatatatatatatatcgtatcacc

SEQ ID NO: 98 - DNA, 68 bp, synthetic construct
  source 1..68: mol_type = other DNA
ggtgatcctttttattttttatatatatatatattttttatttttatatatatatatataggatcacc

SEQ ID NO: 99 - DNA, 68 bp, synthetic construct
  source 1..68: mol_type = other DNA
ggtgatcctttttatttttgatatatatatatattttttatttttatatatatatatatcggatcacc

SEQ ID NO: 100 - DNA, 72 bp, synthetic construct
  source 1..72: mol_type = other DNA
gatatatcactttttattttttatatatatatatattttttatttttatatatatatatatagtgatatatc

SEQ ID NO: 101 - DNA, 72 bp, synthetic construct
  source 1..72: mol_type = other DNA
gtatatacattttttatttttgatatatatatatattttttatttttatatatatatatatcatgtatatac

SEQ ID NO: 102 - DNA, 72 bp, synthetic construct
  source 1..72: mol_type = other DNA
ggatatacactttttattttttatatatatatatattttttatttttatatatatatatatagtgtatatcc

SEQ ID NO: 103 - DNA, 72 bp, synthetic construct
  source 1..72: mol_type = other DNA
ggatatacattttttatttttgatatatatatatattttttatttttatatatatatatatcatgtatatcc

SEQ ID NO: 104 - DNA, 72 bp, synthetic construct
  source 1..72: mol_type = other DNA
gggtatatactttttattttttatatatatatatattttttatttttatatatatatatatagtatataccc

SEQ ID NO: 105 - DNA, 72 bp, synthetic construct
  source 1..72: mol_type = other DNA
ggatatacactttttatttttgatatatatatatattttttatttttatatatatatatatcgtgtatatcc

SEQ ID NO: 106 - DNA, 72 bp, synthetic construct
  source 1..72: mol_type = other DNA
gggtatatactttttatttttgatatatatatatattttttatttttatatatatatatatcgtatataccc

SEQ ID NO: 107 - DNA, 66 bp, synthetic construct
  source 1..66: mol_type = other DNA
gtatatactttttattttttatatatatatatatttttattttttatatatatatatagtatatac

SEQ ID NO: 108 - DNA, 66 bp, synthetic construct
  source 1..66: mol_type = other DNA
gtatatactttttatttttgatatatatatatatttttattttttatatatatatatcgtatatac

SEQ ID NO: 109 - DNA, 66 bp, synthetic construct
  source 1..66: mol_type = other DNA
gtatatactttttatttttgatatatgtatatatttttattttttatatacatatatcgtatatac

SEQ ID NO: 110 - DNA, 66 bp, synthetic construct
  source 1..66: mol_type = other DNA
ggatatactttttattttttatatatatatatatttttattttttatatatatatatagtatatcc

SEQ ID NO: 111 - DNA, 66 bp, synthetic construct
  source 1..66: mol_type = other DNA
ggatatactttttatttttgatatatatatatatttttattttttatatatatatatcgtatatcc

SEQ ID NO: 112 - DNA, 66 bp, synthetic construct
  source 1..66: mol_type = other DNA
ggatatactttttatttttgatatatgtatatatttttattttttatatacatatatcgtatatcc

SEQ ID NO: 113 - DNA, 66 bp, synthetic construct
  source 1..66: mol_type = other DNA
ggtgatactttttattttttatatatatatatatttttattttttatatatatatatagtatcacc

SEQ ID NO: 114 - DNA, 66 bp, synthetic construct
  source 1..66: mol_type = other DNA
ggtgatactttttatttttgatatatatatatatttttattttttatatatatatatcgtatcacc

SEQ ID NO: 115 - DNA, 66 bp, synthetic construct
  source 1..66: mol_type = other DNA
ggtgatactttttatttttgatatatgtatatatttttattttttatatacatatatcgtatcacc

SEQ ID NO: 116 - DNA, 66 bp, synthetic construct
  source 1..66: mol_type = other DNA
ggtgatcctttttattttttatatatatatatatttttattttttatatatatatataggatcacc

SEQ ID NO: 117 - DNA, 66 bp, synthetic construct
  source 1..66: mol_type = other DNA
ggtgatcctttttatttttgatatatatatatatttttattttttatatatatatatcggatcacc

SEQ ID NO: 118 - DNA, 66 bp, synthetic construct
  source 1..66: mol_type = other DNA
ggtgatcctttttatttttgatatatgtatatatttttattttttatatacatatatcggatcacc

SEQ ID NO: 119 - DNA, 70 bp, synthetic construct
  source 1..70: mol_type = other DNA
gatatatcactttttattttttatatatatatatatttttattttttatatatatatatagtgatatatc

SEQ ID NO: 120 - DNA, 70 bp, synthetic construct
  source 1..70: mol_type = other DNA
gtatatacattttttatttttgatatatatatatatttttattttttatatatatatatcatgtatatac

SEQ ID NO: 121 - DNA, 70 bp, synthetic construct
  source 1..70: mol_type = other DNA
gtatatacattttttatttttgatatatgtatatatttttattttttatatacatatatcatgtatatac

SEQ ID NO: 122 - DNA, 70 bp, synthetic construct
  source 1..70: mol_type = other DNA
ggatatacactttttattttttatatatatatatatttttattttttatatatatatatagtgtatatcc

SEQ ID NO: 123 - DNA, 70 bp, synthetic construct
  source 1..70: mol_type = other DNA
ggatatacattttttatttttgatatatatatatatttttattttttatatatatatatcatgtatatcc

SEQ ID NO: 124 - DNA, 70 bp, synthetic construct
  source 1..70: mol_type = other DNA
ggatatacattttttatttttgatatatgtatatatttttattttttatatacatatatcatgtatatcc

SEQ ID NO: 125 - DNA, 70 bp, synthetic construct
  source 1..70: mol_type = other DNA
gggtatatactttttattttttatatatatatatatttttattttttatatatatatatagtatataccc

SEQ ID NO: 126 - DNA, 70 bp, synthetic construct
  source 1..70: mol_type = other DNA
ggatatacactttttatttttgatatatatatatatttttattttttatatatatatatcgtgtatatcc

SEQ ID NO: 127 - DNA, 70 bp, synthetic construct
  source 1..70: mol_type = other DNA
ggatatacactttttatttttgatatatgtatatatttttattttttatatacatatatcgtgtatatcc

SEQ ID NO: 128 - DNA, 70 bp, synthetic construct
  source 1..70: mol_type = other DNA
gggtatatactttttatttttgatatatatatatatttttattttttatatatatatatcgtatataccc

SEQ ID NO: 129 - DNA, 70 bp, synthetic construct
  source 1..70: mol_type = other DNA
gggtatatactttttatttttgatatatgtatatatttttattttttatatacatatatcgtatataccc

SEQ ID NO: 130 - DNA, 68 bp, synthetic construct
  source 1..68: mol_type = other DNA
gatatatcactttttattttttatatatatatattttttatttttatatatatatatagtgatatatc

SEQ ID NO: 131 - DNA, 68 bp, synthetic construct
  source 1..68: mol_type = other DNA
gtatatacattttttatttttgatatatatatattttttatttttatatatatatatcatgtatatac

SEQ ID NO: 132 - DNA, 68 bp, synthetic construct
  source 1..68: mol_type = other DNA
gtatatacattttttatttttgatatatgtatattttttatttttatatacatatatcatgtatatac

SEQ ID NO: 133 - DNA, 68 bp, synthetic construct
  source 1..68: mol_type = other DNA
ggatatacactttttattttttatatatatatattttttatttttatatatatatatagtgtatatcc

SEQ ID NO: 134 - DNA, 68 bp, synthetic construct
  source 1..68: mol_type = other DNA
ggatatacattttttatttttgatatatatatattttttatttttatatatatatatcatgtatatcc

SEQ ID NO: 135 - DNA, 68 bp, synthetic construct
  source 1..68: mol_type = other DNA
ggatatacattttttatttttgatatatgtatattttttatttttatatacatatatcatgtatatcc

SEQ ID NO: 136 - DNA, 68 bp, synthetic construct
  source 1..68: mol_type = other DNA
gggtatatactttttattttttatatatatatattttttatttttatatatatatatagtatataccc

SEQ ID NO: 137 - DNA, 68 bp, synthetic construct
  source 1..68: mol_type = other DNA
ggatatacactttttatttttgatatatatatattttttatttttatatatatatatcgtgtatatcc

SEQ ID NO: 138 - DNA, 68 bp, synthetic construct
  source 1..68: mol_type = other DNA
ggatatacactttttatttttgatatatgtatattttttatttttatatacatatatcgtgtatatcc

SEQ ID NO: 139 - DNA, 68 bp, synthetic construct
  source 1..68: mol_type = other DNA
gggtatatactttttatttttgatatatatatattttttatttttatatatatatatcgtatataccc

SEQ ID NO: 140 - DNA, 68 bp, synthetic construct
  source 1..68: mol_type = other DNA
gggtatatactttttatttttgatatatgtatattttttatttttatatacatatatcgtatataccc

SEQ ID NO: 141 - DNA, 66 bp, synthetic construct
  source 1..66: mol_type = other DNA
gatatatcactttttattttttatatatatatatttttattttttatatatatatagtgatatatc

SEQ ID NO: 142 - DNA, 66 bp, synthetic construct
  source 1..66: mol_type = other DNA
gtatatacattttttatttttgatatatatatatttttattttttatatatatatcatgtatatac

SEQ ID NO: 143 - DNA, 66 bp, synthetic construct
  source 1..66: mol_type = other DNA
gtatatacattttttatttttgatatatgtatatttttattttttatacatatatcatgtatatac

SEQ ID NO: 144 - DNA, 66 bp, synthetic construct
  source 1..66: mol_type = other DNA
gtatatacattttttatttttgatcatgtatattttttatttttatatacatgatcatgtatatac

SEQ ID NO: 145 - DNA, 66 bp, synthetic construct
  source 1..66: mol_type = other DNA
gtatatacattttttatttttgatcatatatgttttttatttttacatatatgatcatgtatatac

SEQ ID NO: 146 - DNA, 66 bp, synthetic construct
  source 1..66: mol_type = other DNA
ggatatacactttttattttttatatatatatatttttattttttatatatatatagtgtatatcc

SEQ ID NO: 147 - DNA, 66 bp, synthetic construct
  source 1..66: mol_type = other DNA
ggatatacattttttatttttgatatatatatatttttattttttatatatatatcatgtatatcc

SEQ ID NO: 148 - DNA, 66 bp, synthetic construct
  source 1..66: mol_type = other DNA
ggatatacattttttatttttgatatatgtatatttttattttttatacatatatcatgtatatcc

SEQ ID NO: 149 - DNA, 66 bp, synthetic construct
  source 1..66: mol_type = other DNA
ggatatacattttttatttttgatcatgtatattttttatttttatatacatgatcatgtatatcc

SEQ ID NO: 150 - DNA, 66 bp, synthetic construct
  source 1..66: mol_type = other DNA
ggatatacattttttatttttgatcatatatgttttttatttttacatatatgatcatgtatatcc

SEQ ID NO: 151 - DNA, 66 bp, synthetic construct
  source 1..66: mol_type = other DNA
gggtatatactttttattttttatatatatatatttttattttttatatatatatagtatataccc

SEQ ID NO: 152 - DNA, 66 bp, synthetic construct
  source 1..66: mol_type = other DNA
ggatatacactttttatttttgatatatatatatttttattttttatatatatatcgtgtatatcc

SEQ ID NO: 153 - DNA, 66 bp, synthetic construct
  source 1..66: mol_type = other DNA
ggatatacactttttatttttgatatatgtatatttttattttttatacatatatcgtgtatatcc

SEQ ID NO: 154 - DNA, 66 bp, synthetic construct
  source 1..66: mol_type = other DNA
ggatatacactttttatttttgatcatgtatattttttatttttatatacatgatcgtgtatatcc

SEQ ID NO: 155 - DNA, 66 bp, synthetic construct
  source 1..66: mol_type = other DNA
ggatatacactttttatttttgatcatatatgttttttatttttacatatatgatcgtgtatatcc

SEQ ID NO: 156 - DNA, 66 bp, synthetic construct
  source 1..66: mol_type = other DNA
gggtatatactttttatttttgatatatatatatttttattttttatatatatatcgtatataccc

SEQ ID NO: 157 - DNA, 66 bp, synthetic construct
  source 1..66: mol_type = other DNA
gggtatatactttttatttttgatatatgtatatttttattttttatacatatatcgtatataccc

SEQ ID NO: 158 - DNA, 66 bp, synthetic construct
  source 1..66: mol_type = other DNA
gggtatatactttttatttttgatcatgtatattttttatttttatatacatgatcgtatataccc

SEQ ID NO: 159 - DNA, 66 bp, synthetic construct
  source 1..66: mol_type = other DNA
gggtatatactttttatttttgatcatatatgttttttatttttacatatatgatcgtatataccc

SEQ ID NO: 160 - DNA, 64 bp, synthetic construct
  source 1..64: mol_type = other DNA
gtacatatatttttttatttttgatatatatatttttattttttatatatatcaatatatgtac

SEQ ID NO: 161 - DNA, 64 bp, synthetic construct
  source 1..64: mol_type = other DNA
gtacatatatttttttatttttgatatatgtatttttattttttacatatatcaatatatgtac

SEQ ID NO: 162 - DNA, 64 bp, synthetic construct
  source 1..64: mol_type = other DNA
gtacatatatttttttatttttgatcatgtattttttatttttatacatgatcaatatatgtac

SEQ ID NO: 163 - DNA, 64 bp, synthetic construct
  source 1..64: mol_type = other DNA
gtacatatatttttttatttttgatcatatattttttatttttatatatgatcaatatatgtac

SEQ ID NO: 164 - DNA, 64 bp, synthetic construct
  source 1..64: mol_type = other DNA
gatgtatatactttttattttttatatatatatttttattttttatatatatagtatatacatc

SEQ ID NO: 165 - DNA, 64 bp, synthetic construct
  source 1..64: mol_type = other DNA
ggtacatatattttttatttttgatatatatatttttattttttatatatatcatatatgtacc

SEQ ID NO: 166 - DNA, 64 bp, synthetic construct
  source 1..64: mol_type = other DNA
ggtacatatattttttatttttgatatatgtatttttattttttacatatatcatatatgtacc

SEQ ID NO: 167 - DNA, 64 bp, synthetic construct
  source 1..64: mol_type = other DNA
ggtacatatattttttatttttgatcatgtattttttatttttatacatgatcatatatgtacc

SEQ ID NO: 168 - DNA, 64 bp, synthetic construct
  source 1..64: mol_type = other DNA
ggtacatatattttttatttttgatcatatattttttatttttatatatgatcatatatgtacc

SEQ ID NO: 169 - DNA, 66 bp, synthetic construct
  source 1..66: mol_type = other DNA
cgatcatatatttttttatttttgatatatatatttttattttttatatatatcaatatatgatcg

SEQ ID NO: 170 - DNA, 66 bp, synthetic construct
  source 1..66: mol_type = other DNA
cgatcatatatttttttatttttgatatatgtatttttattttttacatatatcaatatatgatcg

SEQ ID NO: 171 - DNA, 66 bp, synthetic construct
  source 1..66: mol_type = other DNA
cgatcatatatttttttatttttgatcatgtattttttatttttatacatgatcaatatatgatcg

SEQ ID NO: 172 - DNA, 66 bp, synthetic construct
  source 1..66: mol_type = other DNA
cgatcatatatttttttatttttgatcatatattttttatttttatatatgatcaatatatgatcg

SEQ ID NO: 173 - DNA, 62 bp, synthetic construct
  source 1..62: mol_type = other DNA
gatactttttattttttataaatatatatattttttatttttatatatatatatatagtatc

SEQ ID NO: 174 - DNA, 62 bp, synthetic construct
  source 1..62: mol_type = other DNA
gacactttttattttttataaatatatatattttttatttttatatatatatatatagtgtc

SEQ ID NO: 175 - DNA, 62 bp, synthetic construct
  source 1..62: mol_type = other DNA
gatactttttatttttgataaatatatatattttttatttttatatatatatatatcgtatc

SEQ ID NO: 176 - DNA, 62 bp, synthetic construct
  source 1..62: mol_type = other DNA
gatactttttatttttgataaatgtatatattttttatttttatatatacatatatcgtatc

SEQ ID NO: 177 - DNA, 62 bp, synthetic construct
  source 1..62: mol_type = other DNA
gatactttttatttttgatgatgtatatatatttttattttttatatatacatgatcgtatc

SEQ ID NO: 178 - DNA, 62 bp, synthetic construct
  source 1..62: mol_type = other DNA
gatactttttatttttgatgatatatgtacttttttatttttagtacatatatgatcgtatc

SEQ ID NO: 179 - DNA, 62 bp, synthetic construct
  source 1..62: mol_type = other DNA
ggatctttttattttttataaatatatatattttttatttttatatatatatatatagatcc

SEQ ID NO: 180 - DNA, 62 bp, synthetic construct
  source 1..62: mol_type = other DNA
gacactttttatttttgataaatatatatattttttatttttatatatatatatatcgtgtc

SEQ ID NO: 181 - DNA, 62 bp, synthetic construct
  source 1..62: mol_type = other DNA
gacactttttatttttgataaatgtatatattttttatttttatatatacatatatcgtgtc

SEQ ID NO: 182 - DNA, 62 bp, synthetic construct
  source 1..62: mol_type = other DNA
gacactttttatttttgatgatgtatatatatttttattttttatatatacatgatcgtgtc

SEQ ID NO: 183 - DNA, 62 bp, synthetic construct
  source 1..62: mol_type = other DNA
gacactttttatttttgatgatatatgtacttttttatttttagtacatatatgatcgtgtc

SEQ ID NO: 184 - DNA, 62 bp, synthetic construct
  source 1..62: mol_type = other DNA
ggatctttttatttttgataaatatatatattttttatttttatatatatatatatcgatcc

SEQ ID NO: 185 - DNA, 62 bp, synthetic construct
  source 1..62: mol_type = other DNA
ggatctttttatttttgataaatgtatatattttttatttttatatatacatatatcgatcc

SEQ ID NO: 186 - DNA, 62 bp, synthetic construct
  source 1..62: mol_type = other DNA
ggatctttttatttttgatgatgtatatatatttttattttttatatatacatgatcgatcc

SEQ ID NO: 187 - DNA, 62 bp, synthetic construct
  source 1..62: mol_type = other DNA
ggatctttttatttttgatgatatatgtacttttttatttttagtacatatatgatcgatcc

SEQ ID NO: 188 - DNA, 62 bp, synthetic construct
  source 1..62: mol_type = other DNA
gcgtctttttattttttataaatatatatattttttatttttatatatatatatatagacgc

SEQ ID NO: 189 - DNA, 62 bp, synthetic construct
  source 1..62: mol_type = other DNA
gcgtctttttatttttgataaatatatatattttttatttttatatatatatatatcgacgc

SEQ ID NO: 190 - DNA, 62 bp, synthetic construct
  source 1..62: mol_type = other DNA
gcgtctttttatttttgataaatgtatatattttttatttttatatatacatatatcgacgc

SEQ ID NO: 191 - DNA, 62 bp, synthetic construct
  source 1..62: mol_type = other DNA
gcgtctttttatttttgatgatgtatatatatttttattttttatatatacatgatcgacgc

SEQ ID NO: 192 - DNA, 62 bp, synthetic construct
  source 1..62: mol_type = other DNA
gcgtctttttatttttgatgatatatgtacttttttatttttagtacatatatgatcgacgc

SEQ ID NO: 193 - DNA, 62 bp, synthetic construct
  source 1..62: mol_type = other DNA
gtatactttttatttttgataaatatatatatttttattttttatatatatatatcgtatac

SEQ ID NO: 194 - DNA, 62 bp, synthetic construct
  source 1..62: mol_type = other DNA
gtatactttttatttttgataaatgtatatatttttattttttatatacatatatcgtatac

SEQ ID NO: 195 - DNA, 62 bp, synthetic construct
  source 1..62: mol_type = other DNA
gtatactttttatttttgatgatgtatatattttttatttttatatatacatgatcgtatac

SEQ ID NO: 196 - DNA, 62 bp, synthetic construct
  source 1..62: mol_type = other DNA
gtatactttttatttttgatgatatatgtactttttatttttgtacatatatgatcgtatac

SEQ ID NO: 197 - DNA, 62 bp, synthetic construct
  source 1..62: mol_type = other DNA
gtgatctttttatttttgataaatatatatatttttattttttatatatatatatcgatcac

SEQ ID NO: 198 - DNA, 62 bp, synthetic construct
  source 1..62: mol_type = other DNA
gtgatctttttatttttgataaatgtatatatttttattttttatatacatatatcgatcac

SEQ ID NO: 199 - DNA, 62 bp, synthetic construct
  source 1..62: mol_type = other DNA
gtgatctttttatttttgatgatgtatatattttttatttttatatatacatgatcgatcac

SEQ ID NO: 200 - DNA, 62 bp, synthetic construct
  source 1..62: mol_type = other DNA
gtgatctttttatttttgatgatatatgtactttttatttttgtacatatatgatcgatcac

SEQ ID NO: 201 - DNA, 62 bp, synthetic construct
  source 1..62: mol_type = other DNA
ggatactttttatttttgataaatatatatatttttattttttatatatatatatcgtatcc

SEQ ID NO: 202 - DNA, 62 bp, synthetic construct
  source 1..62: mol_type = other DNA
ggatactttttatttttgataaatgtatatatttttattttttatatacatatatcgtatcc

SEQ ID NO: 203 - DNA, 62 bp, synthetic construct
  source 1..62: mol_type = other DNA
ggatactttttatttttgatgatgtatatattttttatttttatatatacatgatcgtatcc

SEQ ID NO: 204 - DNA, 62 bp, synthetic construct
  source 1..62: mol_type = other DNA
ggatactttttatttttgatgatatatgtactttttatttttgtacatatatgatcgtatcc

SEQ ID NO: 205 - DNA, 62 bp, synthetic construct
  source 1..62: mol_type = other DNA
gcgatctttttatttttgataaatatatatatttttattttttatatatatatatcgatcgc

SEQ ID NO: 206 - DNA, 62 bp, synthetic construct
  source 1..62: mol_type = other DNA
gcgatctttttatttttgataaatgtatatatttttattttttatatacatatatcgatcgc

SEQ ID NO: 207 - DNA, 62 bp, synthetic construct
  source 1..62: mol_type = other DNA
gcgatctttttatttttgatgatgtatatattttttatttttatatatacatgatcgatcgc

SEQ ID NO: 208 - DNA, 62 bp, synthetic construct
  source 1..62: mol_type = other DNA
gcgatctttttatttttgatgatatatgtactttttatttttgtacatatatgatcgatcgc

SEQ ID NO: 209 - DNA, 62 bp, synthetic construct
  source 1..62: mol_type = other DNA
gatatactttttattttttataaatatatattttttatttttatatatatatatagtatatc

SEQ ID NO: 210 - DNA, 62 bp, synthetic construct
  source 1..62: mol_type = other DNA
gatatattttttatttttgataaatgtatattttttatttttatatacatatatcatatatc

SEQ ID NO: 211 - DNA, 62 bp, synthetic construct
  source 1..62: mol_type = other DNA
gatatattttttatttttgatgatgtatatatttttattttttatatacatgatcatatatc

SEQ ID NO: 212 - DNA, 62 bp, synthetic construct
  source 1..62: mol_type = other DNA
gatatattttttatttttgatgatatatgtatttttattttttacatatatgatcatatatc

SEQ ID NO: 213 - DNA, 62 bp, synthetic construct
  source 1..62: mol_type = other DNA
gtgatactttttattttttataaatatatattttttatttttatatatatatatagtatcac

SEQ ID NO: 214 - DNA, 62 bp, synthetic construct
  source 1..62: mol_type = other DNA
gatatactttttatttttgataaatatatattttttatttttatatatatatatcgtatatc

SEQ ID NO: 215 - DNA, 62 bp, synthetic construct
  source 1..62: mol_type = other DNA
gatatactttttatttttgatgatgtatatatttttattttttatatacatgatcgtatatc

SEQ ID NO: 216 - DNA, 62 bp, synthetic construct
  source 1..62: mol_type = other DNA
gatatactttttatttttgatgatatatgtatttttattttttacatatatgatcgtatatc

SEQ ID NO: 217 - DNA, 62 bp, synthetic construct
  source 1..62: mol_type = other DNA
ggtatactttttattttttataaatatatattttttatttttatatatatatatagtatacc

SEQ ID NO: 218 - DNA, 62 bp, synthetic construct
  source 1..62: mol_type = other DNA
gtgatactttttatttttgataaatatatattttttatttttatatatatatatcgtatcac

SEQ ID NO: 219 - DNA, 62 bp, synthetic construct
  source 1..62: mol_type = other DNA
gtgatactttttatttttgataaatgtatattttttatttttatatacatatatcgtatcac

SEQ ID NO: 220 - DNA, 62 bp, synthetic construct
  source 1..62: mol_type = other DNA
gtgatactttttatttttgatgatgtatatatttttattttttatatacatgatcgtatcac

SEQ ID NO: 221 - DNA, 62 bp, synthetic construct
  source 1..62: mol_type = other DNA
gtgatactttttatttttgatgatatatgtatttttattttttacatatatgatcgtatcac

SEQ ID NO: 222 - DNA, 62 bp, synthetic construct
  source 1..62: mol_type = other DNA
ggtatactttttatttttgataaatatatattttttatttttatatatatatatcgtatacc

SEQ ID NO: 223 - DNA, 62 bp, synthetic construct
  source 1..62: mol_type = other DNA
ggtatactttttatttttgataaatgtatattttttatttttatatacatatatcgtatacc

SEQ ID NO: 224 - DNA, 62 bp, synthetic construct
  source 1..62: mol_type = other DNA
ggtatactttttatttttgatgatgtatatatttttattttttatatacatgatcgtatacc

SEQ ID NO: 225 - DNA, 62 bp, synthetic construct
  source 1..62: mol_type = other DNA
ggtatactttttatttttgatgatatatgtatttttattttttacatatatgatcgtatacc

SEQ ID NO: 226 - DNA, 62 bp, synthetic construct
  source 1..62: mol_type = other DNA
ggtgtactttttattttttataaatatatattttttatttttatatatatatatagtacacc

SEQ ID NO: 227 - DNA, 62 bp, synthetic construct
  source 1..62: mol_type = other DNA
ggtgtactttttatttttgataaatatatattttttatttttatatatatatatcgtacacc

SEQ ID NO: 228 - DNA, 62 bp, synthetic construct
  source 1..62: mol_type = other DNA
ggtgtactttttatttttgataaatgtatattttttatttttatatacatatatcgtacacc

SEQ ID NO: 229 - DNA, 62 bp, synthetic construct
  source 1..62: mol_type = other DNA
ggtgtactttttatttttgatgatgtatatatttttattttttatatacatgatcgtacacc

SEQ ID NO: 230 - DNA, 62 bp, synthetic construct
  source 1..62: mol_type = other DNA
ggtgtactttttatttttgatgatatatgtatttttattttttacatatatgatcgtacacc

SEQ ID NO: 231 - DNA, 62 bp, synthetic construct
  source 1..62: mol_type = other DNA
gtatatactttttatttttgataaatatatatttttattttttatatatatatcgtatatac

SEQ ID NO: 232 - DNA, 62 bp, synthetic construct
  source 1..62: mol_type = other DNA
gtatatactttttatttttgataaatgtatatttttattttttatacatatatcgtatatac

SEQ ID NO: 233 - DNA, 62 bp, synthetic construct
  source 1..62: mol_type = other DNA
gtatatactttttatttttgatgatgtatattttttatttttatatacatgatcgtatatac

SEQ ID NO: 234 - DNA, 62 bp, synthetic construct
  source 1..62: mol_type = other DNA
gtatatactttttatttttgatgatatatgttttttatttttacatatatgatcgtatatac

SEQ ID NO: 235 - DNA, 62 bp, synthetic construct
  source 1..62: mol_type = other DNA
ggatatactttttatttttgataaatatatatttttattttttatatatatatcgtatatcc

SEQ ID NO: 236 - DNA, 62 bp, synthetic construct
  source 1..62: mol_type = other DNA
ggatatactttttatttttgataaatgtatatttttattttttatacatatatcgtatatcc

SEQ ID NO: 237 - DNA, 62 bp, synthetic construct
  source 1..62: mol_type = other DNA
ggatatactttttatttttgatgatgtatattttttatttttatatacatgatcgtatatcc

SEQ ID NO: 238 - DNA, 62 bp, synthetic construct
  source 1..62: mol_type = other DNA
ggatatactttttatttttgatgatatatgttttttatttttacatatatgatcgtatatcc

SEQ ID NO: 239 - DNA, 62 bp, synthetic construct
  source 1..62: mol_type = other DNA
ggtgatactttttatttttgataaatatatatttttattttttatatatatatcgtatcacc

SEQ ID NO: 240 - DNA, 62 bp, synthetic construct
  source 1..62: mol_type = other DNA
ggtgatactttttatttttgataaatgtatatttttattttttatacatatatcgtatcacc

SEQ ID NO: 241 - DNA, 62 bp, synthetic construct
  source 1..62: mol_type = other DNA
ggtgatactttttatttttgatgatgtatattttttatttttatatacatgatcgtatcacc

SEQ ID NO: 242 - DNA, 62 bp, synthetic construct
  source 1..62: mol_type = other DNA
ggtgatactttttatttttgatgatatatgttttttatttttacatatatgatcgtatcacc

SEQ ID NO: 243 - DNA, 62 bp, synthetic construct
  source 1..62: mol_type = other DNA
ggtgatcctttttatttttgataaatatatatttttattttttatatatatatcggatcacc

SEQ ID NO: 244 - DNA, 62 bp, synthetic construct
  source 1..62: mol_type = other DNA
ggtgatcctttttatttttgataaatgtatatttttattttttatacatatatcggatcacc

SEQ ID NO: 245 - DNA, 62 bp, synthetic construct
  source 1..62: mol_type = other DNA
ggtgatcctttttatttttgatgatgtatattttttatttttatatacatgatcggatcacc

SEQ ID NO: 246 - DNA, 62 bp, synthetic construct
  source 1..62: mol_type = other DNA
ggtgatcctttttatttttgatgatatatgttttttatttttacatatatgatcggatcacc

SEQ ID NO: 247 - DNA, 62 bp, synthetic construct
  source 1..62: mol_type = other DNA
gtatatacattttttatttttgataaatatatttttattttttatatatatcatgtatatac

SEQ ID NO: 248 - DNA, 62 bp, synthetic construct
  source 1..62: mol_type = other DNA
gtatatacattttttatttttgataaatgtatttttattttttacatatatcatgtatatac

SEQ ID NO: 249 - DNA, 62 bp, synthetic construct
  source 1..62: mol_type = other DNA
gtatatacattttttatttttgatgatgtattttttatttttatacatgatcatgtatatac

SEQ ID NO: 250 - DNA, 62 bp, synthetic construct
  source 1..62: mol_type = other DNA
gtatatacattttttatttttgatgatatattttttatttttatatatgatcatgtatatac

SEQ ID NO: 251 - DNA, 62 bp, synthetic construct
  source 1..62: mol_type = other DNA
ggatatacattttttatttttgataaatatatttttattttttatatatatcatgtatatcc

SEQ ID NO: 252 - DNA, 62 bp, synthetic construct
  source 1..62: mol_type = other DNA
ggatatacattttttatttttgataaatgtatttttattttttacatatatcatgtatatcc

SEQ ID NO: 253 - DNA, 62 bp, synthetic construct
  source 1..62: mol_type = other DNA
ggatatacattttttatttttgatgatgtattttttatttttatacatgatcatgtatatcc

SEQ ID NO: 254 - DNA, 62 bp, synthetic construct
  source 1..62: mol_type = other DNA
ggatatacattttttatttttgatgatatattttttatttttatatatgatcatgtatatcc

SEQ ID NO: 255 - DNA, 62 bp, synthetic construct
  source 1..62: mol_type = other DNA
ggatatacactttttatttttgataaatatatttttattttttatatatatcgtgtatatcc

SEQ ID NO: 256 - DNA, 62 bp, synthetic construct
  source 1..62: mol_type = other DNA
ggatatacactttttatttttgataaatgtatttttattttttacatatatcgtgtatatcc

SEQ ID NO: 257 - DNA, 62 bp, synthetic construct
  source 1..62: mol_type = other DNA
ggatatacactttttatttttgatgatgtattttttatttttatacatgatcgtgtatatcc

SEQ ID NO: 258 - DNA, 62 bp, synthetic construct
  source 1..62: mol_type = other DNA
ggatatacactttttatttttgatgatatattttttatttttatatatgatcgtgtatatcc

SEQ ID NO: 259 - DNA, 62 bp, synthetic construct
  source 1..62: mol_type = other DNA
gggtatatactttttatttttgataaatatatttttattttttatatatatcgtatataccc

SEQ ID NO: 260 - DNA, 62 bp, synthetic construct
  source 1..62: mol_type = other DNA
gggtatatactttttatttttgataaatgtatttttattttttacatatatcgtatataccc

SEQ ID NO: 261 - DNA, 62 bp, synthetic construct
  source 1..62: mol_type = other DNA
gggtatatactttttatttttgatgatgtattttttatttttatacatgatcgtatataccc

SEQ ID NO: 262 - DNA, 62 bp, synthetic construct
  source 1..62: mol_type = other DNA
gggtatatactttttatttttgatgatatattttttatttttatatatgatcgtatataccc

SEQ ID NO: 263 - DNA, 62 bp, synthetic construct
  source 1..62: mol_type = other DNA
ggatgtacactttttatttttgataaatatatttttattttttatatatatcgtgtacatcc

SEQ ID NO: 264 - DNA, 62 bp, synthetic construct
  source 1..62: mol_type = other DNA
ggatgtacactttttatttttgataaatgtatttttattttttacatatatcgtgtacatcc

SEQ ID NO: 265 - DNA, 62 bp, synthetic construct
  source 1..62: mol_type = other DNA
ggatgtacactttttatttttgatgatgtattttttatttttatacatgatcgtgtacatcc

SEQ ID NO: 266 - DNA, 62 bp, synthetic construct
  source 1..62: mol_type = other DNA
ggatgtacactttttatttttgatgatatattttttatttttatatatgatcgtgtacatcc

SEQ ID NO: 267 - DNA, 68 bp, synthetic construct
  source 1..68: mol_type = other DNA
gtatatactttttattttttataaatatatatattttttatttttatatatatatatatagtatatac

SEQ ID NO: 268 - DNA, 68 bp, synthetic construct
  source 1..68: mol_type = other DNA
gtatatactttttatttttgataaatatatatattttttatttttatatatatatatatcgtatatac

SEQ ID NO: 269 - DNA, 68 bp, synthetic construct
  source 1..68: mol_type = other DNA
gtatatactttttatttttgataaatgtatatattttttatttttatatatacatatatcgtatatac

SEQ ID NO: 270 - DNA, 68 bp, synthetic construct
  source 1..68: mol_type = other DNA
gtatatactttttatttttgatgatgtatatatatttttattttttatatatacatgatcgtatatac

SEQ ID NO: 271 - DNA, 68 bp, synthetic construct
  source 1..68: mol_type = other DNA
gtatatactttttatttttgatgatatatgtacttttttatttttagtacatatatgatcgtatatac

SEQ ID NO: 272 - DNA, 68 bp, synthetic construct
  source 1..68: mol_type = other DNA
ggatatactttttattttttataaatatatatattttttatttttatatatatatatatagtatatcc

SEQ ID NO: 273 - DNA, 68 bp, synthetic construct
  source 1..68: mol_type = other DNA
ggatatactttttatttttgataaatatatatattttttatttttatatatatatatatcgtatatcc

SEQ ID NO: 274 - DNA, 68 bp, synthetic construct
  source 1..68: mol_type = other DNA
ggatatactttttatttttgataaatgtatatattttttatttttatatatacatatatcgtatatcc

SEQ ID NO: 275 - DNA, 68 bp, synthetic construct
  source 1..68: mol_type = other DNA
ggatatactttttatttttgatgatgtatatatatttttattttttatatatacatgatcgtatatcc

SEQ ID NO: 276 - DNA, 68 bp, synthetic construct
  source 1..68: mol_type = other DNA
ggatatactttttatttttgatgatatatgtacttttttatttttagtacatatatgatcgtatatcc

SEQ ID NO: 277 - DNA, 68 bp, synthetic construct
  source 1..68: mol_type = other DNA
ggtgatactttttattttttataaatatatatattttttatttttatatatatatatatagtatcacc

SEQ ID NO: 278 - DNA, 68 bp, synthetic construct
  source 1..68: mol_type = other DNA
ggtgatactttttatttttgataaatatatatattttttatttttatatatatatatatcgtatcacc

SEQ ID NO: 279 - DNA, 68 bp, synthetic construct
  source 1..68: mol_type = other DNA
ggtgatactttttatttttgataaatgtatatattttttatttttatatatacatatatcgtatcacc

SEQ ID NO: 280 - DNA, 68 bp, synthetic construct
  source 1..68: mol_type = other DNA
ggtgatactttttatttttgatgatgtatatatatttttattttttatatatacatgatcgtatcacc

SEQ ID NO: 281 - DNA, 68 bp, synthetic construct
  source 1..68: mol_type = other DNA
ggtgatactttttatttttgatgatatatgtacttttttatttttagtacatatatgatcgtatcacc

SEQ ID NO: 282 - DNA, 68 bp, synthetic construct
  source 1..68: mol_type = other DNA
ggtgatcctttttattttttataaatatatatattttttatttttatatatatatatataggatcacc

SEQ ID NO: 283 - DNA, 68 bp, synthetic construct
  source 1..68: mol_type = other DNA
ggtgatcctttttatttttgataaatatatatattttttatttttatatatatatatatcggatcacc

SEQ ID NO: 284 - DNA, 68 bp, synthetic construct
  source 1..68: mol_type = other DNA
ggtgatcctttttatttttgataaatgtatatattttttatttttatatatacatatatcggatcacc

SEQ ID NO: 285 - DNA, 68 bp, synthetic construct
  source 1..68: mol_type = other DNA
ggtgatcctttttatttttgatgatgtatatatatttttattttttatatatacatgatcggatcacc

SEQ ID NO: 286 - DNA, 68 bp, synthetic construct
  source 1..68: mol_type = other DNA
ggtgatcctttttatttttgatgatatatgtacttttttatttttagtacatatatgatcggatcacc

SEQ ID NO: 287 - DNA, 72 bp, synthetic construct
  source 1..72: mol_type = other DNA
gatatatcactttttattttttataaatatatatattttttatttttatatatatatatatagtgatatatc

SEQ ID NO: 288 - DNA, 72 bp, synthetic construct
  source 1..72: mol_type = other DNA
gtatatacattttttatttttgataaatatatatattttttatttttatatatatatatatcatgtatatac

SEQ ID NO: 289 - DNA, 72 bp, synthetic construct
  source 1..72: mol_type = other DNA
gtatatacattttttatttttgataaatgtatatattttttatttttatatatacatatatcatgtatatac

SEQ ID NO: 290 - DNA, 72 bp, synthetic construct
  source 1..72: mol_type = other DNA
gtatatacattttttatttttgatgatgtatatatatttttattttttatatatacatgatcatgtatatac

SEQ ID NO: 291 - DNA, 72 bp, synthetic construct
  source 1..72: mol_type = other DNA
gtatatacattttttatttttgatgatatatgtacttttttatttttagtacatatatgatcatgtatatac

SEQ ID NO: 292 - DNA, 72 bp, synthetic construct
  source 1..72: mol_type = other DNA
ggatatacactttttattttttataaatatatatattttttatttttatatatatatatatagtgtatatcc

SEQ ID NO: 293 - DNA, 72 bp, synthetic construct
  source 1..72: mol_type = other DNA
ggatatacattttttatttttgataaatatatatattttttatttttatatatatatatatcatgtatatcc

SEQ ID NO: 294 - DNA, 72 bp, synthetic construct
  source 1..72: mol_type = other DNA
ggatatacattttttatttttgataaatgtatatattttttatttttatatatacatatatcatgtatatcc

SEQ ID NO: 295 - DNA, 72 bp, synthetic construct
  source 1..72: mol_type = other DNA
ggatatacattttttatttttgatgatgtatatatatttttattttttatatatacatgatcatgtatatcc

SEQ ID NO: 296 - DNA, 72 bp, synthetic construct
  source 1..72: mol_type = other DNA
ggatatacattttttatttttgatgatatatgtacttttttatttttagtacatatatgatcatgtatatcc

SEQ ID NO: 297 - DNA, 72 bp, synthetic construct
  source 1..72: mol_type = other DNA
gggtatatactttttattttttataaatatatatattttttatttttatatatatatatatagtatataccc

SEQ ID NO: 298 - DNA, 72 bp, synthetic construct
  source 1..72: mol_type = other DNA
ggatatacactttttatttttgataaatatatatattttttatttttatatatatatatatcgtgtatatcc

SEQ ID NO: 299 - DNA, 72 bp, synthetic construct
  source 1..72: mol_type = other DNA
ggatatacactttttatttttgataaatgtatatattttttatttttatatatacatatatcgtgtatatcc

SEQ ID NO: 300 - DNA, 72 bp, synthetic construct
  source 1..72: mol_type = other DNA
ggatatacactttttatttttgatgatgtatatatatttttattttttatatatacatgatcgtgtatatcc

SEQ ID NO: 301 - DNA, 72 bp, synthetic construct
  source 1..72: mol_type = other DNA
ggatatacactttttatttttgatgatatatgtacttttttatttttagtacatatatgatcgtgtatatcc

SEQ ID NO: 302 - DNA, 72 bp, synthetic construct
  source 1..72: mol_type = other DNA
gggtatatactttttatttttgataaatatatatattttttatttttatatatatatatatcgtatataccc

SEQ ID NO: 303 - DNA, 72 bp, synthetic construct
  source 1..72: mol_type = other DNA
gggtatatactttttatttttgataaatgtatatattttttatttttatatatacatatatcgtatataccc

SEQ ID NO: 304 - DNA, 72 bp, synthetic construct
  source 1..72: mol_type = other DNA
gggtatatactttttatttttgatgatgtatatatatttttattttttatatatacatgatcgtatataccc

SEQ ID NO: 305 - DNA, 72 bp, synthetic construct
  source 1..72: mol_type = other DNA
gggtatatactttttatttttgatgatatatgtacttttttatttttagtacatatatgatcgtatataccc

SEQ ID NO: 306 - DNA, 66 bp, synthetic construct
  source 1..66: mol_type = other DNA
gtatatactttttatttttgataaatatatatatttttattttttatatatatatatcgtatatac

SEQ ID NO: 307 - DNA, 66 bp, synthetic construct
  source 1..66: mol_type = other DNA
gtatatactttttatttttgataaatgtatatatttttattttttatatacatatatcgtatatac

SEQ ID NO: 308 - DNA, 66 bp, synthetic construct
  source 1..66: mol_type = other DNA
gtatatactttttatttttgatgatgtatatattttttatttttatatatacatgatcgtatatac

SEQ ID NO: 309 - DNA, 66 bp, synthetic construct
  source 1..66: mol_type = other DNA
gtatatactttttatttttgatgatatatgtactttttatttttgtacatatatgatcgtatatac

SEQ ID NO: 310 - DNA, 66 bp, synthetic construct
  source 1..66: mol_type = other DNA
ggatatactttttatttttgataaatatatatatttttattttttatatatatatatcgtatatcc

SEQ ID NO: 311 - DNA, 66 bp, synthetic construct
  source 1..66: mol_type = other DNA
ggatatactttttatttttgataaatgtatatatttttattttttatatacatatatcgtatatcc

SEQ ID NO: 312 - DNA, 66 bp, synthetic construct
  source 1..66: mol_type = other DNA
ggatatactttttatttttgatgatgtatatattttttatttttatatatacatgatcgtatatcc

SEQ ID NO: 313 - DNA, 66 bp, synthetic construct
  source 1..66: mol_type = other DNA
ggatatactttttatttttgatgatatatgtactttttatttttgtacatatatgatcgtatatcc

SEQ ID NO: 314 - DNA, 66 bp, synthetic construct
  source 1..66: mol_type = other DNA
ggtgatactttttatttttgataaatatatatatttttattttttatatatatatatcgtatcacc

SEQ ID NO: 315 - DNA, 66 bp, synthetic construct
  source 1..66: mol_type = other DNA
ggtgatactttttatttttgataaatgtatatatttttattttttatatacatatatcgtatcacc

SEQ ID NO: 316 - DNA, 66 bp, synthetic construct
  source 1..66: mol_type = other DNA
ggtgatactttttatttttgatgatgtatatattttttatttttatatatacatgatcgtatcacc

SEQ ID NO: 317 - DNA, 66 bp, synthetic construct
  source 1..66: mol_type = other DNA
ggtgatactttttatttttgatgatatatgtactttttatttttgtacatatatgatcgtatcacc

SEQ ID NO: 318 - DNA, 66 bp, synthetic construct
  source 1..66: mol_type = other DNA
ggtgatcctttttatttttgataaatatatatatttttattttttatatatatatatcggatcacc

SEQ ID NO: 319 - DNA, 66 bp, synthetic construct
  source 1..66: mol_type = other DNA
ggtgatcctttttatttttgataaatgtatatatttttattttttatatacatatatcggatcacc

SEQ ID NO: 320 - DNA, 66 bp, synthetic construct
  source 1..66: mol_type = other DNA
ggtgatcctttttatttttgatgatgtatatattttttatttttatatatacatgatcggatcacc

SEQ ID NO: 321 - DNA, 66 bp, synthetic construct
  source 1..66: mol_type = other DNA
ggtgatcctttttatttttgatgatatatgtactttttatttttgtacatatatgatcggatcacc

SEQ ID NO: 322 - DNA, 70 bp, synthetic construct
  source 1..70: mol_type = other DNA
gtatatacattttttatttttgataaatatatatatttttattttttatatatatatatcatgtatatac

SEQ ID NO: 323 - DNA, 70 bp, synthetic construct
  source 1..70: mol_type = other DNA
gtatatacattttttatttttgatgatgtatatattttttatttttatatatacatgatcatgtatatac

SEQ ID NO: 324 - DNA, 70 bp, synthetic construct
  source 1..70: mol_type = other DNA
gtatatacattttttatttttgatgatatatgtactttttatttttgtacatatatgatcatgtatatac

SEQ ID NO: 325 - DNA, 70 bp, synthetic construct
  source 1..70: mol_type = other DNA
ggatatacattttttatttttgataaatatatatatttttattttttatatatatatatcatgtatatcc

SEQ ID NO: 326 - DNA, 70 bp, synthetic construct
  source 1..70: mol_type = other DNA
ggatatacattttttatttttgataaatgtatatatttttattttttatatacatatatcatgtatatcc

SEQ ID NO: 327 - DNA, 70 bp, synthetic construct
  source 1..70: mol_type = other DNA
ggatatacattttttatttttgatgatgtatatattttttatttttatatatacatgatcatgtatatcc

SEQ ID NO: 328 - DNA, 70 bp, synthetic construct
  source 1..70: mol_type = other DNA
ggatatacattttttatttttgatgatatatgtactttttatttttgtacatatatgatcatgtatatcc

SEQ ID NO: 329 - DNA, 70 bp, synthetic construct
  source 1..70: mol_type = other DNA
ggatatacactttttatttttgataaatatatatatttttattttttatatatatatatcgtgtatatcc

SEQ ID NO: 330 - DNA, 70 bp, synthetic construct
  source 1..70: mol_type = other DNA
ggatatacactttttatttttgataaatgtatatatttttattttttatatacatatatcgtgtatatcc

SEQ ID NO: 331 - DNA, 70 bp, synthetic construct
  source 1..70: mol_type = other DNA
ggatatacactttttatttttgatgatgtatatattttttatttttatatatacatgatcgtgtatatcc

SEQ ID NO: 332 - DNA, 70 bp, synthetic construct
  source 1..70: mol_type = other DNA
ggatatacactttttatttttgatgatatatgtactttttatttttgtacatatatgatcgtgtatatcc

SEQ ID NO: 333 - DNA, 70 bp, synthetic construct
  source 1..70: mol_type = other DNA
gggtatatactttttatttttgataaatatatatatttttattttttatatatatatatcgtatataccc

SEQ ID NO: 334 - DNA, 70 bp, synthetic construct
  source 1..70: mol_type = other DNA
gggtatatactttttatttttgataaatgtatatatttttattttttatatacatatatcgtatataccc

SEQ ID NO: 335 - DNA, 70 bp, synthetic construct
  source 1..70: mol_type = other DNA
gggtatatactttttatttttgatgatgtatatattttttatttttatatatacatgatcgtatataccc

SEQ ID NO: 336 - DNA, 70 bp, synthetic construct
  source 1..70: mol_type = other DNA
gggtatatactttttatttttgatgatatatgtactttttatttttgtacatatatgatcgtatataccc

SEQ ID NO: 337 - DNA, 68 bp, synthetic construct
  source 1..68: mol_type = other DNA
gatatatcactttttattttttataaatatatattttttatttttatatatatatatagtgatatatc

SEQ ID NO: 338 - DNA, 68 bp, synthetic construct
  source 1..68: mol_type = other DNA
gtatatacattttttatttttgataaatatatattttttatttttatatatatatatcatgtatatac

SEQ ID NO: 339 - DNA, 68 bp, synthetic construct
  source 1..68: mol_type = other DNA
gtatatacattttttatttttgatgatgtatatatttttattttttatatacatgatcatgtatatac

SEQ ID NO: 340 - DNA, 68 bp, synthetic construct
  source 1..68: mol_type = other DNA
gtatatacattttttatttttgatgatatatgtatttttattttttacatatatgatcatgtatatac

SEQ ID NO: 341 - DNA, 68 bp, synthetic construct
  source 1..68: mol_type = other DNA
ggatatacactttttattttttataaatatatattttttatttttatatatatatatagtgtatatcc

SEQ ID NO: 342 - DNA, 68 bp, synthetic construct
  source 1..68: mol_type = other DNA
ggatatacattttttatttttgataaatatatattttttatttttatatatatatatcatgtatatcc

SEQ ID NO: 343 - DNA, 68 bp, synthetic construct
  source 1..68: mol_type = other DNA
ggatatacattttttatttttgataaatgtatattttttatttttatatacatatatcatgtatatcc

SEQ ID NO: 344 - DNA, 68 bp, synthetic construct
  source 1..68: mol_type = other DNA
ggatatacattttttatttttgatgatgtatatatttttattttttatatacatgatcatgtatatcc

SEQ ID NO: 345 - DNA, 68 bp, synthetic construct
  source 1..68: mol_type = other DNA
ggatatacattttttatttttgatgatatatgtatttttattttttacatatatgatcatgtatatcc

SEQ ID NO: 346 - DNA, 68 bp, synthetic construct
  source 1..68: mol_type = other DNA
gggtatatactttttattttttataaatatatattttttatttttatatatatatatagtatataccc

SEQ ID NO: 347 - DNA, 68 bp, synthetic construct
  source 1..68: mol_type = other DNA
ggatatacactttttatttttgataaatatatattttttatttttatatatatatatcgtgtatatcc

SEQ ID NO: 348 - DNA, 68 bp, synthetic construct
  source 1..68: mol_type = other DNA
ggatatacactttttatttttgataaatgtatattttttatttttatatacatatatcgtgtatatcc

SEQ ID NO: 349 - DNA, 68 bp, synthetic construct
  source 1..68: mol_type = other DNA
ggatatacactttttatttttgatgatgtatatatttttattttttatatacatgatcgtgtatatcc

SEQ ID NO: 350 - DNA, 68 bp, synthetic construct
  source 1..68: mol_type = other DNA
ggatatacactttttatttttgatgatatatgtatttttattttttacatatatgatcgtgtatatcc

SEQ ID NO: 351 - DNA, 68 bp, synthetic construct
  source 1..68: mol_type = other DNA
gggtatatactttttatttttgataaatatatattttttatttttatatatatatatcgtatataccc

SEQ ID NO: 352 - DNA, 68 bp, synthetic construct
  source 1..68: mol_type = other DNA
gggtatatactttttatttttgataaatgtatattttttatttttatatacatatatcgtatataccc

SEQ ID NO: 353 - DNA, 68 bp, synthetic construct
  source 1..68: mol_type = other DNA
gggtatatactttttatttttgatgatgtatatatttttattttttatatacatgatcgtatataccc

SEQ ID NO: 354 - DNA, 68 bp, synthetic construct
  source 1..68: mol_type = other DNA
gggtatatactttttatttttgatgatatatgtatttttattttttacatatatgatcgtatataccc

SEQ ID NO: 355 - DNA, 66 bp, synthetic construct
  source 1..66: mol_type = other DNA
gtatatacattttttatttttgataaatatatatttttattttttatatatatatcatgtatatac

SEQ ID NO: 356 - DNA, 66 bp, synthetic construct
  source 1..66: mol_type = other DNA
gtatatacattttttatttttgatgatgtatattttttatttttatatacatgatcatgtatatac

SEQ ID NO: 357 - DNA, 66 bp, synthetic construct
  source 1..66: mol_type = other DNA
gtatatacattttttatttttgatgatatatgttttttatttttacatatatgatcatgtatatac

SEQ ID NO: 358 - DNA, 66 bp, synthetic construct
  source 1..66: mol_type = other DNA
ggatatacattttttatttttgataaatatatatttttattttttatatatatatcatgtatatcc

SEQ ID NO: 359 - DNA, 66 bp, synthetic construct
  source 1..66: mol_type = other DNA
ggatatacattttttatttttgataaatgtatatttttattttttatacatatatcatgtatatcc

SEQ ID NO: 360 - DNA, 66 bp, synthetic construct
  source 1..66: mol_type = other DNA
ggatatacattttttatttttgatgatgtatattttttatttttatatacatgatcatgtatatcc

SEQ ID NO: 361 - DNA, 66 bp, synthetic construct
  source 1..66: mol_type = other DNA
ggatatacattttttatttttgatgatatatgttttttatttttacatatatgatcatgtatatcc

SEQ ID NO: 362 - DNA, 66 bp, synthetic construct
  source 1..66: mol_type = other DNA
ggatatacactttttatttttgataaatatatatttttattttttatatatatatcgtgtatatcc

SEQ ID NO: 363 - DNA, 66 bp, synthetic construct
  source 1..66: mol_type = other DNA
ggatatacactttttatttttgataaatgtatatttttattttttatacatatatcgtgtatatcc

SEQ ID NO: 364 - DNA, 66 bp, synthetic construct
  source 1..66: mol_type = other DNA
ggatatacactttttatttttgatgatgtatattttttatttttatatacatgatcgtgtatatcc

SEQ ID NO: 365 - DNA, 66 bp, synthetic construct
  source 1..66: mol_type = other DNA
ggatatacactttttatttttgatgatatatgttttttatttttacatatatgatcgtgtatatcc

SEQ ID NO: 366 - DNA, 66 bp, synthetic construct
  source 1..66: mol_type = other DNA
gggtatatactttttatttttgataaatatatatttttattttttatatatatatcgtatataccc

SEQ ID NO: 367 - DNA, 66 bp, synthetic construct
  source 1..66: mol_type = other DNA
gggtatatactttttatttttgataaatgtatatttttattttttatacatatatcgtatataccc

SEQ ID NO: 368 - DNA, 66 bp, synthetic construct
  source 1..66: mol_type = other DNA
gggtatatactttttatttttgatgatgtatattttttatttttatatacatgatcgtatataccc

SEQ ID NO: 369 - DNA, 66 bp, synthetic construct
  source 1..66: mol_type = other DNA
gggtatatactttttatttttgatgatatatgttttttatttttacatatatgatcgtatataccc

SEQ ID NO: 370 - DNA, 64 bp, synthetic construct
  source 1..64: mol_type = other DNA
gtacatatatttttttatttttgataaatatatttttattttttatatatatcaatatatgtac

SEQ ID NO: 371 - DNA, 64 bp, synthetic construct
  source 1..64: mol_type = other DNA
gtacatatatttttttatttttgataaatgtatttttattttttacatatatcaatatatgtac

SEQ ID NO: 372 - DNA, 64 bp, synthetic construct
  source 1..64: mol_type = other DNA
gtacatatatttttttatttttgatgatgtattttttatttttatacatgatcaatatatgtac

SEQ ID NO: 373 - DNA, 64 bp, synthetic construct
  source 1..64: mol_type = other DNA
gtacatatatttttttatttttgatgatatattttttatttttatatatgatcaatatatgtac

SEQ ID NO: 374 - DNA, 64 bp, synthetic construct
  source 1..64: mol_type = other DNA
ggtacatatattttttatttttgataaatatatttttattttttatatatatcatatatgtacc

SEQ ID NO: 375 - DNA, 64 bp, synthetic construct
  source 1..64: mol_type = other DNA
ggtacatatattttttatttttgataaatgtatttttattttttacatatatcatatatgtacc

SEQ ID NO: 376 - DNA, 64 bp, synthetic construct
  source 1..64: mol_type = other DNA
ggtacatatattttttatttttgatgatgtattttttatttttatacatgatcatatatgtacc

SEQ ID NO: 377 - DNA, 64 bp, synthetic construct
  source 1..64: mol_type = other DNA
ggtacatatattttttatttttgatgatatattttttatttttatatatgatcatatatgtacc

SEQ ID NO: 378 - DNA, 66 bp, synthetic construct
  source 1..66: mol_type = other DNA
cgatcatatatttttttatttttgataaatatatttttattttttatatatatcaatatatgatcg

SEQ ID NO: 379 - DNA, 66 bp, synthetic construct
  source 1..66: mol_type = other DNA
cgatcatatatttttttatttttgataaatgtatttttattttttacatatatcaatatatgatcg

SEQ ID NO: 380 - DNA, 66 bp, synthetic construct
  source 1..66: mol_type = other DNA
cgatcatatatttttttatttttgatgatgtattttttatttttatacatgatcaatatatgatcg

SEQ ID NO: 381 - DNA, 66 bp, synthetic construct
  source 1..66: mol_type = other DNA
cgatcatatatttttttatttttgatgatatattttttatttttatatatgatcaatatatgatcg

SEQ ID NO: 382 - DNA, 68 bp, synthetic construct
  source 1..68: mol_type = other DNA
gtatatactttttatttttgatgatgtaaatatatttttattttttatatatacatgatcgtatatac

SEQ ID NO: 383 - DNA, 68 bp, synthetic construct
  source 1..68: mol_type = other DNA
gtatatactttttatttttgatgatataagtacttttttatttttagtacatatatgatcgtatatac

SEQ ID NO: 384 - DNA, 68 bp, synthetic construct
  source 1..68: mol_type = other DNA
ggatatactttttatttttgatgatgtaaatatatttttattttttatatatacatgatcgtatatcc

SEQ ID NO: 385 - DNA, 68 bp, synthetic construct
  source 1..68: mol_type = other DNA
ggatatactttttatttttgatgatataagtacttttttatttttagtacatatatgatcgtatatcc

SEQ ID NO: 386 - DNA, 68 bp, synthetic construct
  source 1..68: mol_type = other DNA
ggtgatactttttatttttgatgatgtaaatatatttttattttttatatatacatgatcgtatcacc

SEQ ID NO: 387 - DNA, 68 bp, synthetic construct
  source 1..68: mol_type = other DNA
ggtgatactttttatttttgatgatataagtacttttttatttttagtacatatatgatcgtatcacc

SEQ ID NO: 388 - DNA, 68 bp, synthetic construct
  source 1..68: mol_type = other DNA
ggtgatcctttttatttttgatgatgtaaatatatttttattttttatatatacatgatcggatcacc

SEQ ID NO: 389 - DNA, 68 bp, synthetic construct
  source 1..68: mol_type = other DNA
ggtgatcctttttatttttgatgatataagtacttttttatttttagtacatatatgatcggatcacc

SEQ ID NO: 390 - DNA, 72 bp, synthetic construct
  source 1..72: mol_type = other DNA
gtatatacattttttatttttgatgatgtaaatatatttttattttttatatatacatgatcatgtatatac

SEQ ID NO: 391 - DNA, 72 bp, synthetic construct
  source 1..72: mol_type = other DNA
gtatatacattttttatttttgatgatataagtacttttttatttttagtacatatatgatcatgtatatac

SEQ ID NO: 392 - DNA, 72 bp, synthetic construct
  source 1..72: mol_type = other DNA
ggatatacattttttatttttgataaatgtaaatattttttatttttatatatacatatatcatgtatatcc

SEQ ID NO: 393 - DNA, 72 bp, synthetic construct
  source 1..72: mol_type = other DNA
ggatatacattttttatttttgatgatgtaaatatatttttattttttatatatacatgatcatgtatatcc

SEQ ID NO: 394 - DNA, 72 bp, synthetic construct
  source 1..72: mol_type = other DNA
ggatatacattttttatttttgatgatataagtacttttttatttttagtacatatatgatcatgtatatcc

SEQ ID NO: 395 - DNA, 72 bp, synthetic construct
  source 1..72: mol_type = other DNA
ggatatacactttttatttttgatgatgtaaatatatttttattttttatatatacatgatcgtgtatatcc

SEQ ID NO: 396 - DNA, 72 bp, synthetic construct
  source 1..72: mol_type = other DNA
ggatatacactttttatttttgatgatataagtacttttttatttttagtacatatatgatcgtgtatatcc

SEQ ID NO: 397 - DNA, 72 bp, synthetic construct
  source 1..72: mol_type = other DNA
gggtatatactttttatttttgatgatgtaaatatatttttattttttatatatacatgatcgtatataccc

SEQ ID NO: 398 - DNA, 72 bp, synthetic construct
  source 1..72: mol_type = other DNA
gggtatatactttttatttttgatgatataagtacttttttatttttagtacatatatgatcgtatataccc

SEQ ID NO: 399 - DNA, 66 bp, synthetic construct
  source 1..66: mol_type = other DNA
gtatatactttttatttttgatgatgtaaatattttttatttttatatatacatgatcgtatatac

SEQ ID NO: 400 - DNA, 66 bp, synthetic construct
  source 1..66: mol_type = other DNA
gtatatactttttatttttgatgatataagtactttttatttttgtacatatatgatcgtatatac

SEQ ID NO: 401 - DNA, 66 bp, synthetic construct
  source 1..66: mol_type = other DNA
ggatatactttttatttttgatgatgtaaatattttttatttttatatatacatgatcgtatatcc

SEQ ID NO: 402 - DNA, 66 bp, synthetic construct
  source 1..66: mol_type = other DNA
ggatatactttttatttttgatgatataagtactttttatttttgtacatatatgatcgtatatcc

SEQ ID NO: 403 - DNA, 66 bp, synthetic construct
  source 1..66: mol_type = other DNA
ggtgatactttttatttttgatgatgtaaatattttttatttttatatatacatgatcgtatcacc

SEQ ID NO: 404 - DNA, 66 bp, synthetic construct
  source 1..66: mol_type = other DNA
ggtgatactttttatttttgatgatataagtactttttatttttgtacatatatgatcgtatcacc

SEQ ID NO: 405 - DNA, 66 bp, synthetic construct
  source 1..66: mol_type = other DNA
ggtgatcctttttatttttgatgatgtaaatattttttatttttatatatacatgatcggatcacc

SEQ ID NO: 406 - DNA, 66 bp, synthetic construct
  source 1..66: mol_type = other DNA
ggtgatcctttttatttttgatgatataagtactttttatttttgtacatatatgatcggatcacc

SEQ ID NO: 407 - DNA, 70 bp, synthetic construct
  source 1..70: mol_type = other DNA
gtatatacattttttatttttgatgatgtaaatattttttatttttatatatacatgatcatgtatatac

SEQ ID NO: 408 - DNA, 70 bp, synthetic construct
  source 1..70: mol_type = other DNA
gtatatacattttttatttttgatgatataagtactttttatttttgtacatatatgatcatgtatatac

SEQ ID NO: 409 - DNA, 70 bp, synthetic construct
  source 1..70: mol_type = other DNA
ggatatacattttttatttttgatgatgtaaatattttttatttttatatatacatgatcatgtatatcc

SEQ ID NO: 410 - DNA, 70 bp, synthetic construct
  source 1..70: mol_type = other DNA
ggatatacattttttatttttgatgatataagtactttttatttttgtacatatatgatcatgtatatcc

SEQ ID NO: 411 - DNA, 70 bp, synthetic construct
  source 1..70: mol_type = other DNA
ggatatacactttttatttttgatgatgtaaatattttttatttttatatatacatgatcgtgtatatcc

SEQ ID NO: 412 - DNA, 70 bp, synthetic construct
  source 1..70: mol_type = other DNA
ggatatacactttttatttttgatgatataagtactttttatttttgtacatatatgatcgtgtatatcc

SEQ ID NO: 413 - DNA, 70 bp, synthetic construct
  source 1..70: mol_type = other DNA
gggtatatactttttatttttgatgatgtaaatattttttatttttatatatacatgatcgtatataccc

SEQ ID NO: 414 - DNA, 70 bp, synthetic construct
  source 1..70: mol_type = other DNA
gggtatatactttttatttttgatgatataagtactttttatttttgtacatatatgatcgtatataccc

SEQ ID NO: 415 - DNA, 68 bp, synthetic construct
  source 1..68: mol_type = other DNA
gtatatacattttttatttttgatgatataagtatttttattttttacatatatgatcatgtatatac

SEQ ID NO: 416 - DNA, 68 bp, synthetic construct
  source 1..68: mol_type = other DNA
ggatatacattttttatttttgataaatgaatattttttatttttatatacatatatcatgtatatcc

SEQ ID NO: 417 - DNA, 68 bp, synthetic construct
  source 1..68: mol_type = other DNA
ggatatacattttttatttttgatgatataagtatttttattttttacatatatgatcatgtatatcc

SEQ ID NO: 418 - DNA, 68 bp, synthetic construct
  source 1..68: mol_type = other DNA
ggatatacactttttatttttgataaatgaatattttttatttttatatacatatatcgtgtatatcc

SEQ ID NO: 419 - DNA, 68 bp, synthetic construct
  source 1..68: mol_type = other DNA
ggatatacactttttatttttgatgatataagtatttttattttttacatatatgatcgtgtatatcc

SEQ ID NO: 420 - DNA, 68 bp, synthetic construct
  source 1..68: mol_type = other DNA
gggtatatactttttatttttgataaatgaatattttttatttttatatacatatatcgtatataccc

SEQ ID NO: 421 - DNA, 68 bp, synthetic construct
  source 1..68: mol_type = other DNA
gggtatatactttttatttttgatgatataagtatttttattttttacatatatgatcgtatataccc

SEQ ID NO: 422 - DNA, 66 bp, synthetic construct
  source 1..66: mol_type = other DNA
gtatatacattttttatttttgatgatgaatattttttatttttatatacatgatcatgtatatac

SEQ ID NO: 423 - DNA, 66 bp, synthetic construct
  source 1..66: mol_type = other DNA
ggatatacattttttatttttgataaatgaatatttttattttttatacatatatcatgtatatcc

SEQ ID NO: 424 - DNA, 66 bp, synthetic construct
  source 1..66: mol_type = other DNA
ggatatacattttttatttttgatgatgaatattttttatttttatatacatgatcatgtatatcc

SEQ ID NO: 425 - DNA, 66 bp, synthetic construct
  source 1..66: mol_type = other DNA
ggatatacattttttatttttgatgataaatgttttttatttttacatatatgatcatgtatatcc

SEQ ID NO: 426 - DNA, 66 bp, synthetic construct
  source 1..66: mol_type = other DNA
ggatatacactttttatttttgatgatgaatattttttatttttatatacatgatcgtgtatatcc

SEQ ID NO: 427 - DNA, 66 bp, synthetic construct
  source 1..66: mol_type = other DNA
gggtatatactttttatttttgatgatgaatattttttatttttatatacatgatcgtatataccc

SEQ ID NO: 428 - DNA, 62 bp, synthetic construct
  source 1..62: mol_type = other DNA
gatactttttatttttgatgatgtaaatatatttttattttttatatatacatgatcgtatc

SEQ ID NO: 429 - DNA, 62 bp, synthetic construct
  source 1..62: mol_type = other DNA
gatactttttatttttgatgatataagtacttttttatttttagtacatatatgatcgtatc

SEQ ID NO: 430 - DNA, 62 bp, synthetic construct
  source 1..62: mol_type = other DNA
gacactttttatttttgatgatgtaaatatatttttattttttatatatacatgatcgtgtc

SEQ ID NO: 431 - DNA, 62 bp, synthetic construct
  source 1..62: mol_type = other DNA
gacactttttatttttgatgatataagtacttttttatttttagtacatatatgatcgtgtc

SEQ ID NO: 432 - DNA, 62 bp, synthetic construct
  source 1..62: mol_type = other DNA
ggatctttttatttttgatgatgtaaatatatttttattttttatatatacatgatcgatcc

SEQ ID NO: 433 - DNA, 62 bp, synthetic construct
  source 1..62: mol_type = other DNA
ggatctttttatttttgatgatataagtacttttttatttttagtacatatatgatcgatcc

SEQ ID NO: 434 - DNA, 62 bp, synthetic construct
  source 1..62: mol_type = other DNA
gcgtctttttatttttgatgatgtaaatatatttttattttttatatatacatgatcgacgc

SEQ ID NO: 435 - DNA, 62 bp, synthetic construct
  source 1..62: mol_type = other DNA
gcgtctttttatttttgatgatataagtacttttttatttttagtacatatatgatcgacgc

SEQ ID NO: 436 - DNA, 62 bp, synthetic construct
  source 1..62: mol_type = other DNA
gtatactttttatttttgatgatgtaaatattttttatttttatatatacatgatcgtatac

SEQ ID NO: 437 - DNA, 62 bp, synthetic construct
  source 1..62: mol_type = other DNA
gtatactttttatttttgatgatataagtactttttatttttgtacatatatgatcgtatac

SEQ ID NO: 438 - DNA, 62 bp, synthetic construct
  source 1..62: mol_type = other DNA
gtgatctttttatttttgatgatgtaaatattttttatttttatatatacatgatcgatcac

SEQ ID NO: 439 - DNA, 62 bp, synthetic construct
  source 1..62: mol_type = other DNA
gtgatctttttatttttgatgatataagtactttttatttttgtacatatatgatcgatcac

SEQ ID NO: 440 - DNA, 62 bp, synthetic construct
  source 1..62: mol_type = other DNA
ggatactttttatttttgatgatgtaaatattttttatttttatatatacatgatcgtatcc

SEQ ID NO: 441 - DNA, 62 bp, synthetic construct
  source 1..62: mol_type = other DNA
ggatactttttatttttgatgatataagtactttttatttttgtacatatatgatcgtatcc

SEQ ID NO: 442 - DNA, 62 bp, synthetic construct
  source 1..62: mol_type = other DNA
gcgatctttttatttttgatgatgtaaatattttttatttttatatatacatgatcgatcgc

SEQ ID NO: 443 - DNA, 62 bp, synthetic construct
  source 1..62: mol_type = other DNA
gcgatctttttatttttgatgatataagtactttttatttttgtacatatatgatcgatcgc

SEQ ID NO: 444 - DNA, 62 bp, synthetic construct
  source 1..62: mol_type = other DNA
gatatattttttatttttgatgatataagtatttttattttttacatatatgatcatatatc

SEQ ID NO: 445 - DNA, 62 bp, synthetic construct
  source 1..62: mol_type = other DNA
gatatactttttatttttgatgatataagtatttttattttttacatatatgatcgtatatc

SEQ ID NO: 446 - DNA, 62 bp, synthetic construct
  source 1..62: mol_type = other DNA
gtgatactttttatttttgataaatgaatattttttatttttatatacatatatcgtatcac

SEQ ID NO: 447 - DNA, 62 bp, synthetic construct
  source 1..62: mol_type = other DNA
gtgatactttttatttttgatgatataagtatttttattttttacatatatgatcgtatcac

SEQ ID NO: 448 - DNA, 62 bp, synthetic construct
  source 1..62: mol_type = other DNA
ggtatactttttatttttgataaatgaatattttttatttttatatacatatatcgtatacc

SEQ ID NO: 449 - DNA, 62 bp, synthetic construct
  source 1..62: mol_type = other DNA
ggtatactttttatttttgatgatataagtatttttattttttacatatatgatcgtatacc

SEQ ID NO: 450 - DNA, 62 bp, synthetic construct
  source 1..62: mol_type = other DNA
ggtgtactttttatttttgataaatgaatattttttatttttatatacatatatcgtacacc

SEQ ID NO: 451 - DNA, 62 bp, synthetic construct
  source 1..62: mol_type = other DNA
ggtgtactttttatttttgatgatataagtatttttattttttacatatatgatcgtacacc

SEQ ID NO: 452 - DNA, 62 bp, synthetic construct
  source 1..62: mol_type = other DNA
gtatatactttttatttttgatgatgaatattttttatttttatatacatgatcgtatatac

SEQ ID NO: 453 - DNA, 62 bp, synthetic construct
  source 1..62: mol_type = other DNA
gtatatactttttatttttgatgataaatgttttttatttttacatatatgatcgtatatac

SEQ ID NO: 454 - DNA, 62 bp, synthetic construct
  source 1..62: mol_type = other DNA
ggatatactttttatttttgatgatgaatattttttatttttatatacatgatcgtatatcc

SEQ ID NO: 455 - DNA, 62 bp, synthetic construct
  source 1..62: mol_type = other DNA
ggtgatactttttatttttgatgatgaatattttttatttttatatacatgatcgtatcacc

SEQ ID NO: 456 - DNA, 62 bp, synthetic construct
  source 1..62: mol_type = other DNA
ggtgatactttttatttttgatgataaatgttttttatttttacatatatgatcgtatcacc

SEQ ID NO: 457 - DNA, 62 bp, synthetic construct
  source 1..62: mol_type = other DNA
ggtgatcctttttatttttgatgatgaatattttttatttttatatacatgatcggatcacc

SEQ ID NO: 458 - DNA, 62 bp, synthetic construct
  source 1..62: mol_type = other DNA
gatactttttatttttgatataaatatataatttttatttttatatatatatatatcgtatc

SEQ ID NO: 459 - DNA, 62 bp, synthetic construct
  source 1..62: mol_type = other DNA
gatactttttatttttgataaatgaatatattttttatttttatatatacatatatcgtatc

SEQ ID NO: 460 - DNA, 62 bp, synthetic construct
  source 1..62: mol_type = other DNA
gacactttttatttttgatataaatatataatttttatttttatatatatatatatcgtgtc

SEQ ID NO: 461 - DNA, 62 bp, synthetic construct
  source 1..62: mol_type = other DNA
gacactttttatttttgataaatgaatatattttttatttttatatatacatatatcgtgtc

SEQ ID NO: 462 - DNA, 62 bp, synthetic construct
  source 1..62: mol_type = other DNA
gacactttttatttttgatataagtaaatattttttatttttatatatacatatatcgtgtc

SEQ ID NO: 463 - DNA, 62 bp, synthetic construct
  source 1..62: mol_type = other DNA
ggatctttttatttttgatataaatatataatttttatttttatatatatatatatcgatcc

SEQ ID NO: 464 - DNA, 62 bp, synthetic construct
  source 1..62: mol_type = other DNA
ggatctttttatttttgataaatgaatatattttttatttttatatatacatatatcgatcc

SEQ ID NO: 465 - DNA, 62 bp, synthetic construct
  source 1..62: mol_type = other DNA
ggatctttttatttttgatataagtaaatattttttatttttatatatacatatatcgatcc

SEQ ID NO: 466 - DNA, 62 bp, synthetic construct
  source 1..62: mol_type = other DNA
gcgtctttttatttttgatataaatatataatttttatttttatatatatatatatcgacgc

SEQ ID NO: 467 - DNA, 62 bp, synthetic construct
  source 1..62: mol_type = other DNA
gcgtctttttatttttgataaatgaatatattttttatttttatatatacatatatcgacgc

SEQ ID NO: 468 - DNA, 62 bp, synthetic construct
  source 1..62: mol_type = other DNA
gcgtctttttatttttgatataagtaaatattttttatttttatatatacatatatcgacgc

SEQ ID NO: 469 - DNA, 72 bp, synthetic construct
  source 1..72: mol_type = other DNA
gtatatacattttttatttttgatataaatatataatttttatttttatatatatatatatcatgtatatac

SEQ ID NO: 470 - DNA, 72 bp, synthetic construct
  source 1..72: mol_type = other DNA
gtatatacattttttatttttgataaatgaatatattttttatttttatatatacatatatcatgtatatac

SEQ ID NO: 471 - DNA, 72 bp, synthetic construct
  source 1..72: mol_type = other DNA
gtatatacattttttatttttgatataagtaaatattttttatttttatatatacatatatcatgtatatac

SEQ ID NO: 472 - DNA, 72 bp, synthetic construct
  source 1..72: mol_type = other DNA
ggatatacattttttatttttgatataaatatataatttttatttttatatatatatatatcatgtatatcc

SEQ ID NO: 473 - DNA, 72 bp, synthetic construct
  source 1..72: mol_type = other DNA
ggatatacactttttatttttgatataaatatataatttttatttttatatatatatatatcgtgtatatcc

SEQ ID NO: 474 - DNA, 72 bp, synthetic construct
  source 1..72: mol_type = other DNA
ggatatacactttttatttttgataaatgaatatattttttatttttatatatacatatatcgtgtatatcc

SEQ ID NO: 475 - DNA, 72 bp, synthetic construct
  source 1..72: mol_type = other DNA
ggatatacactttttatttttgatataagtaaatattttttatttttatatatacatatatcgtgtatatcc

SEQ ID NO: 476 - DNA, 72 bp, synthetic construct
  source 1..72: mol_type = other DNA
gggtatatactttttatttttgatataaatatataatttttatttttatatatatatatatcgtatataccc

SEQ ID NO: 477 - DNA, 72 bp, synthetic construct
  source 1..72: mol_type = other DNA
gggtatatactttttatttttgataaatgaatatattttttatttttatatatacatatatcgtatataccc

SEQ ID NO: 478 - DNA, 72 bp, synthetic construct
  source 1..72: mol_type = other DNA
gggtatatactttttatttttgatataagtaaatattttttatttttatatatacatatatcgtatataccc

SEQ ID NO: 479 - DNA, 62 bp, synthetic construct
  source 1..62: mol_type = other DNA
gtatactttttattttttataaatatatatttttttattttttatatatatatatagtatac

SEQ ID NO: 480 - DNA, 62 bp, synthetic construct
  source 1..62: mol_type = other DNA
gtgatctttttattttttataaatatatatttttttattttttatatatatatatagatcac

SEQ ID NO: 481 - DNA, 62 bp, synthetic construct
  source 1..62: mol_type = other DNA
gtatactttttatttttgatataaatatatttttttattttttatatatatatatcgtatac

SEQ ID NO: 482 - DNA, 62 bp, synthetic construct
  source 1..62: mol_type = other DNA
gtatactttttatttttgatatataaatatttttttattttttatatatatatatcgtatac

SEQ ID NO: 483 - DNA, 62 bp, synthetic construct
  source 1..62: mol_type = other DNA
gtatactttttatttttgataaatgaatatatttttattttttatatacatatatcgtatac

SEQ ID NO: 484 - DNA, 62 bp, synthetic construct
  source 1..62: mol_type = other DNA
ggatactttttattttttataaatatatatttttttattttttatatatatatatagtatcc

SEQ ID NO: 485 - DNA, 62 bp, synthetic construct
  source 1..62: mol_type = other DNA
gtgatctttttatttttgatataaatatatttttttattttttatatatatatatcgatcac

SEQ ID NO: 486 - DNA, 62 bp, synthetic construct
  source 1..62: mol_type = other DNA
gtgatctttttatttttgatatataaatatttttttattttttatatatatatatcgatcac

SEQ ID NO: 487 - DNA, 62 bp, synthetic construct
  source 1..62: mol_type = other DNA
gtgatctttttatttttgataaatgaatatatttttattttttatatacatatatcgatcac

SEQ ID NO: 488 - DNA, 62 bp, synthetic construct
  source 1..62: mol_type = other DNA
ggatactttttatttttgatataaatatatttttttattttttatatatatatatcgtatcc

SEQ ID NO: 489 - DNA, 62 bp, synthetic construct
  source 1..62: mol_type = other DNA
ggatactttttatttttgatatataaatatttttttattttttatatatatatatcgtatcc

SEQ ID NO: 490 - DNA, 62 bp, synthetic construct
  source 1..62: mol_type = other DNA
ggatactttttatttttgataaatgaatatatttttattttttatatacatatatcgtatcc

SEQ ID NO: 491 - DNA, 62 bp, synthetic construct
  source 1..62: mol_type = other DNA
gcgatctttttattttttataaatatatatttttttattttttatatatatatatagatcgc

SEQ ID NO: 492 - DNA, 62 bp, synthetic construct
  source 1..62: mol_type = other DNA
gcgatctttttatttttgatataaatatatttttttattttttatatatatatatcgatcgc

SEQ ID NO: 493 - DNA, 62 bp, synthetic construct
  source 1..62: mol_type = other DNA
gcgatctttttatttttgatatataaatatttttttattttttatatatatatatcgatcgc

SEQ ID NO: 494 - DNA, 62 bp, synthetic construct
  source 1..62: mol_type = other DNA
gcgatctttttatttttgataaatgaatatatttttattttttatatacatatatcgatcgc

SEQ ID NO: 495 - DNA, 70 bp, synthetic construct
  source 1..70: mol_type = other DNA
gatatatcactttttattttttataaatatatatttttttattttttatatatatatatagtgatatatc

SEQ ID NO: 496 - DNA, 70 bp, synthetic construct
  source 1..70: mol_type = other DNA
gtatatacattttttatttttgatataaatatatttttttattttttatatatatatatcatgtatatac

SEQ ID NO: 497 - DNA, 70 bp, synthetic construct
  source 1..70: mol_type = other DNA
gtatatacattttttatttttgatatataaatatttttttattttttatatatatatatcatgtatatac

SEQ ID NO: 498 - DNA, 70 bp, synthetic construct
  source 1..70: mol_type = other DNA
ggatatacactttttattttttataaatatatatttttttattttttatatatatatatagtgtatatcc

SEQ ID NO: 499 - DNA, 70 bp, synthetic construct
  source 1..70: mol_type = other DNA
ggatatacattttttatttttgatataaatatatttttttattttttatatatatatatcatgtatatcc

SEQ ID NO: 500 - DNA, 70 bp, synthetic construct
  source 1..70: mol_type = other DNA
ggatatacattttttatttttgatatataaatatttttttattttttatatatatatatcatgtatatcc

SEQ ID NO: 501 - DNA, 70 bp, synthetic construct
  source 1..70: mol_type = other DNA
ggatatacattttttatttttgataaatgaatatatttttattttttatatacatatatcatgtatatcc

SEQ ID NO: 502 - DNA, 70 bp, synthetic construct
  source 1..70: mol_type = other DNA
gggtatatactttttattttttataaatatatatttttttattttttatatatatatatagtatataccc

SEQ ID NO: 503 - DNA, 70 bp, synthetic construct
  source 1..70: mol_type = other DNA
ggatatacactttttatttttgatataaatatatttttttattttttatatatatatatcgtgtatatcc

SEQ ID NO: 504 - DNA, 70 bp, synthetic construct
  source 1..70: mol_type = other DNA
ggatatacactttttatttttgatatataaatatttttttattttttatatatatatatcgtgtatatcc

SEQ ID NO: 505 - DNA, 70 bp, synthetic construct
  source 1..70: mol_type = other DNA
ggatatacactttttatttttgataaatgaatatatttttattttttatatacatatatcgtgtatatcc

SEQ ID NO: 506 - DNA, 70 bp, synthetic construct
  source 1..70: mol_type = other DNA
gggtatatactttttatttttgatataaatatatttttttattttttatatatatatatcgtatataccc

SEQ ID NO: 507 - DNA, 70 bp, synthetic construct
  source 1..70: mol_type = other DNA
gggtatatactttttatttttgatatataaatatttttttattttttatatatatatatcgtatataccc

SEQ ID NO: 508 - DNA, 70 bp, synthetic construct
  source 1..70: mol_type = other DNA
gggtatatactttttatttttgataaatgaatatatttttattttttatatacatatatcgtatataccc

SEQ ID NO: 509 - DNA, 62 bp, synthetic construct
  source 1..62: mol_type = other DNA
gatatactttttatttttgataaatatataatttttatttttatatatatatatcgtatatc

SEQ ID NO: 510 - DNA, 62 bp, synthetic construct
  source 1..62: mol_type = other DNA
gtgatactttttatttttgataaatatataatttttatttttatatatatatatcgtatcac

SEQ ID NO: 511 - DNA, 62 bp, synthetic construct
  source 1..62: mol_type = other DNA
ggtatactttttatttttgataaatatataatttttatttttatatatatatatcgtatacc

SEQ ID NO: 512 - DNA, 62 bp, synthetic construct
  source 1..62: mol_type = other DNA
ggtgtactttttatttttgataaatatataatttttatttttatatatatatatcgtacacc

SEQ ID NO: 513 - DNA, 68 bp, synthetic construct
  source 1..68: mol_type = other DNA
gtatatacattttttatttttgataaatatataatttttatttttatatatatatatcatgtatatac

SEQ ID NO: 514 - DNA, 68 bp, synthetic construct
  source 1..68: mol_type = other DNA
ggatatacattttttatttttgataaatatataatttttatttttatatatatatatcatgtatatcc

SEQ ID NO: 515 - DNA, 68 bp, synthetic construct
  source 1..68: mol_type = other DNA
ggatatacactttttatttttgataaatatataatttttatttttatatatatatatcgtgtatatcc

SEQ ID NO: 516 - DNA, 68 bp, synthetic construct
  source 1..68: mol_type = other DNA
gggtatatactttttatttttgataaatatataatttttatttttatatatatatatcgtatataccc

SEQ ID NO: 517 - DNA, 62 bp, synthetic construct
  source 1..62: mol_type = other DNA
gtatatactttttatttttgataaatatatttttttattttttatatatatatcgtatatac

SEQ ID NO: 518 - DNA, 62 bp, synthetic construct
  source 1..62: mol_type = other DNA
gtatatactttttatttttgataaatgtatttttttattttttatacatatatcgtatatac

SEQ ID NO: 519 - DNA, 62 bp, synthetic construct
  source 1..62: mol_type = other DNA
ggatatactttttatttttgataaatatatttttttattttttatatatatatcgtatatcc

SEQ ID NO: 520 - DNA, 62 bp, synthetic construct
  source 1..62: mol_type = other DNA
ggatatactttttatttttgataaatgtatttttttattttttatacatatatcgtatatcc

SEQ ID NO: 521 - DNA, 62 bp, synthetic construct
  source 1..62: mol_type = other DNA
ggatatactttttatttttgatgataaatgttttttatttttacatatatgatcgtatatcc

SEQ ID NO: 522 - DNA, 62 bp, synthetic construct
  source 1..62: mol_type = other DNA
ggtgatactttttatttttgataaatatatttttttattttttatatatatatcgtatcacc

SEQ ID NO: 523 - DNA, 62 bp, synthetic construct
  source 1..62: mol_type = other DNA
ggtgatactttttatttttgataaatgtatttttttattttttatacatatatcgtatcacc

SEQ ID NO: 524 - DNA, 62 bp, synthetic construct
  source 1..62: mol_type = other DNA
ggtgatcctttttatttttgataaatatatttttttattttttatatatatatcggatcacc

SEQ ID NO: 525 - DNA, 62 bp, synthetic construct
  source 1..62: mol_type = other DNA
ggtgatcctttttatttttgataaatgtatttttttattttttatacatatatcggatcacc

SEQ ID NO: 526 - DNA, 62 bp, synthetic construct
  source 1..62: mol_type = other DNA
ggtgatcctttttatttttgatgataaatgttttttatttttacatatatgatcggatcacc

SEQ ID NO: 527 - DNA, 66 bp, synthetic construct
  source 1..66: mol_type = other DNA
gtatatacattttttatttttgataaatatatttttttattttttatatatatatcatgtatatac

SEQ ID NO: 528 - DNA, 66 bp, synthetic construct
  source 1..66: mol_type = other DNA
gtatatacattttttatttttgataaatgtatttttttattttttatacatatatcatgtatatac

SEQ ID NO: 529 - DNA, 66 bp, synthetic construct
  source 1..66: mol_type = other DNA
gtatatacattttttatttttgatgataaatgttttttatttttacatatatgatcatgtatatac

SEQ ID NO: 530 - DNA, 66 bp, synthetic construct
  source 1..66: mol_type = other DNA
ggatatacattttttatttttgataaatatatttttttattttttatatatatatcatgtatatcc

SEQ ID NO: 531 - DNA, 66 bp, synthetic construct
  source 1..66: mol_type = other DNA
ggatatacactttttatttttgataaatatatttttttattttttatatatatatcgtgtatatcc

SEQ ID NO: 532 - DNA, 66 bp, synthetic construct
  source 1..66: mol_type = other DNA
ggatatacactttttatttttgataaatgtatttttttattttttatacatatatcgtgtatatcc

SEQ ID NO: 533 - DNA, 66 bp, synthetic construct
  source 1..66: mol_type = other DNA
ggatatacactttttatttttgatgataaatgttttttatttttacatatatgatcgtgtatatcc

SEQ ID NO: 534 - DNA, 66 bp, synthetic construct
  source 1..66: mol_type = other DNA
gggtatatactttttatttttgataaatatatttttttattttttatatatatatcgtatataccc

SEQ ID NO: 535 - DNA, 66 bp, synthetic construct
  source 1..66: mol_type = other DNA
gggtatatactttttatttttgataaatgtatttttttattttttatacatatatcgtatataccc

SEQ ID NO: 536 - DNA, 66 bp, synthetic construct
  source 1..66: mol_type = other DNA
gggtatatactttttatttttgatgataaatgttttttatttttacatatatgatcgtatataccc

SEQ ID NO: 537 - DNA, 62 bp, synthetic construct
  source 1..62: mol_type = other DNA
gtatatacattttttatttttgataaatatttttttattttttatatatatcatgtatatac

SEQ ID NO: 538 - DNA, 62 bp, synthetic construct
  source 1..62: mol_type = other DNA
gtatatacattttttatttttgataaatgtttttttattttttacatatatcatgtatatac

SEQ ID NO: 539 - DNA, 62 bp, synthetic construct
  source 1..62: mol_type = other DNA
ggatatacattttttatttttgataaatatttttttattttttatatatatcatgtatatcc

SEQ ID NO: 540 - DNA, 62 bp, synthetic construct
  source 1..62: mol_type = other DNA
ggatatacattttttatttttgataaatgtttttttattttttacatatatcatgtatatcc

SEQ ID NO: 541 - DNA, 62 bp, synthetic construct
  source 1..62: mol_type = other DNA
ggatatacattttttatttttgatgatgaattttttatttttatacatgatcatgtatatcc

SEQ ID NO: 542 - DNA, 62 bp, synthetic construct
  source 1..62: mol_type = other DNA
ggatatacactttttatttttgataaatatttttttattttttatatatatcgtgtatatcc

SEQ ID NO: 543 - DNA, 62 bp, synthetic construct
  source 1..62: mol_type = other DNA
ggatatacactttttatttttgataaatgtttttttattttttacatatatcgtgtatatcc

SEQ ID NO: 544 - DNA, 62 bp, synthetic construct
  source 1..62: mol_type = other DNA
gggtatatactttttatttttgataaatatttttttattttttatatatatcgtatataccc

SEQ ID NO: 545 - DNA, 62 bp, synthetic construct
  source 1..62: mol_type = other DNA
gggtatatactttttatttttgataaatgtttttttattttttacatatatcgtatataccc

SEQ ID NO: 546 - DNA, 62 bp, synthetic construct
  source 1..62: mol_type = other DNA
ggatgtacactttttatttttgataaatatttttttattttttatatatatcgtgtacatcc

SEQ ID NO: 547 - DNA, 62 bp, synthetic construct
  source 1..62: mol_type = other DNA
ggatgtacactttttatttttgataaatgtttttttattttttacatatatcgtgtacatcc

SEQ ID NO: 548 - DNA, 64 bp, synthetic construct
  source 1..64: mol_type = other DNA
gtacatatatttttttatttttgataaatatttttttattttttatatatatcaatatatgtac

SEQ ID NO: 549 - DNA, 64 bp, synthetic construct
  source 1..64: mol_type = other DNA
gtacatatatttttttatttttgataaatgtttttttattttttacatatatcaatatatgtac

SEQ ID NO: 550 - DNA, 64 bp, synthetic construct
  source 1..64: mol_type = other DNA
ggtacatatattttttatttttgataaatatttttttattttttatatatatcatatatgtacc

SEQ ID NO: 551 - DNA, 64 bp, synthetic construct
  source 1..64: mol_type = other DNA
ggtacatatattttttatttttgataaatgtttttttattttttacatatatcatatatgtacc

SEQ ID NO: 552 - DNA, 66 bp, synthetic construct
  source 1..66: mol_type = other DNA
cgatcatatatttttttatttttgataaatatttttttattttttatatatatcaatatatgatcg

SEQ ID NO: 553 - DNA, 66 bp, synthetic construct
  source 1..66: mol_type = other DNA
cgatcatatatttttttatttttgataaatgtttttttattttttacatatatcaatatatgatcg

SEQ ID NO: 554 - DNA, 66 bp, synthetic construct
  source 1..66: mol_type = other DNA
cgatcatatatttttttatttttgatgatgaattttttatttttatacatgatcaatatatgatcg

SEQ ID NO: 555 - DNA, 66 bp, synthetic construct
  source 1..66: mol_type = other DNA
cgatcatatatttttttatttttgatgataaattttttatttttatatatgatcaatatatgatcg

SEQ ID NO: 556 - DNA, 68 bp, synthetic construct
  source 1..68: mol_type = other DNA
gtatatactttttatttttgatataaatatataatttttatttttatatatatatatatcgtatatac

SEQ ID NO: 557 - DNA, 68 bp, synthetic construct
  source 1..68: mol_type = other DNA
gtatatactttttatttttgataaatgaatatattttttatttttatatatacatatatcgtatatac

SEQ ID NO: 558 - DNA, 68 bp, synthetic construct
  source 1..68: mol_type = other DNA
ggatatactttttatttttgatataaatatataatttttatttttatatatatatatatcgtatatcc

SEQ ID NO: 559 - DNA, 68 bp, synthetic construct
  source 1..68: mol_type = other DNA
ggatatactttttatttttgataaatgaatatattttttatttttatatatacatatatcgtatatcc

SEQ ID NO: 560 - DNA, 68 bp, synthetic construct
  source 1..68: mol_type = other DNA
ggtgatactttttatttttgatataaatatataatttttatttttatatatatatatatcgtatcacc

SEQ ID NO: 561 - DNA, 68 bp, synthetic construct
  source 1..68: mol_type = other DNA
ggtgatactttttatttttgataaatgaatatattttttatttttatatatacatatatcgtatcacc

SEQ ID NO: 562 - DNA, 68 bp, synthetic construct
  source 1..68: mol_type = other DNA
ggtgatcctttttatttttgatataaatatataatttttatttttatatatatatatatcggatcacc

SEQ ID NO: 563 - DNA, 68 bp, synthetic construct
  source 1..68: mol_type = other DNA
ggtgatcctttttatttttgataaatgaatatattttttatttttatatatacatatatcggatcacc

SEQ ID NO: 564 - DNA, 68 bp, synthetic construct
  source 1..68: mol_type = other DNA
gtatatactttttatttttgatataagtaaatattttttatttttatatatacatatatcgtatatac

SEQ ID NO: 565 - DNA, 68 bp, synthetic construct
  source 1..68: mol_type = other DNA
ggatatactttttatttttgatataagtaaatattttttatttttatatatacatatatcgtatatcc

SEQ ID NO: 566 - DNA, 68 bp, synthetic construct
  source 1..68: mol_type = other DNA
ggtgatactttttatttttgatataagtaaatattttttatttttatatatacatatatcgtatcacc

SEQ ID NO: 567 - DNA, 68 bp, synthetic construct
  source 1..68: mol_type = other DNA
ggtgatcctttttatttttgatataagtaaatattttttatttttatatatacatatatcggatcacc

SEQ ID NO: 568 - DNA, 66 bp, synthetic construct
  source 1..66: mol_type = other DNA
gtatatactttttattttttataaatatatatttttttattttttatatatatatatagtatatac

SEQ ID NO: 569 - DNA, 66 bp, synthetic construct
  source 1..66: mol_type = other DNA
gtatatactttttatttttgatataaatatatttttttattttttatatatatatatcgtatatac

SEQ ID NO: 570 - DNA, 66 bp, synthetic construct
  source 1..66: mol_type = other DNA
gtatatactttttatttttgataaatgaatatatttttattttttatatacatatatcgtatatac

SEQ ID NO: 571 - DNA, 66 bp, synthetic construct
  source 1..66: mol_type = other DNA
ggatatactttttattttttataaatatatatttttttattttttatatatatatatagtatatcc

SEQ ID NO: 572 - DNA, 66 bp, synthetic construct
  source 1..66: mol_type = other DNA
ggatatactttttatttttgatataaatatatttttttattttttatatatatatatcgtatatcc

SEQ ID NO: 573 - DNA, 66 bp, synthetic construct
  source 1..66: mol_type = other DNA
ggatatactttttatttttgataaatgaatatatttttattttttatatacatatatcgtatatcc

SEQ ID NO: 574 - DNA, 66 bp, synthetic construct
  source 1..66: mol_type = other DNA
ggtgatactttttattttttataaatatatatttttttattttttatatatatatatagtatcacc

SEQ ID NO: 575 - DNA, 66 bp, synthetic construct
  source 1..66: mol_type = other DNA
ggtgatactttttatttttgatataaatatatttttttattttttatatatatatatcgtatcacc

SEQ ID NO: 576 - DNA, 66 bp, synthetic construct
  source 1..66: mol_type = other DNA
ggtgatactttttatttttgataaatgaatatatttttattttttatatacatatatcgtatcacc

SEQ ID NO: 577 - DNA, 66 bp, synthetic construct
  source 1..66: mol_type = other DNA
ggtgatcctttttattttttataaatatatatttttttattttttatatatatatataggatcacc

SEQ ID NO: 578 - DNA, 66 bp, synthetic construct
  source 1..66: mol_type = other DNA
ggtgatcctttttatttttgatataaatatatttttttattttttatatatatatatcggatcacc

SEQ ID NO: 579 - DNA, 66 bp, synthetic construct
  source 1..66: mol_type = other DNA
ggtgatcctttttatttttgataaatgaatatatttttattttttatatacatatatcggatcacc

SEQ ID NO: 580 - DNA, 66 bp, synthetic construct
  source 1..66: mol_type = other DNA
gtatatactttttatttttgatatataaatatttttttattttttatatatatatatcgtatatac

SEQ ID NO: 581 - DNA, 66 bp, synthetic construct
  source 1..66: mol_type = other DNA
ggatatactttttatttttgatatataaatatttttttattttttatatatatatatcgtatatcc

SEQ ID NO: 582 - DNA, 66 bp, synthetic construct
  source 1..66: mol_type = other DNA
ggtgatactttttatttttgatatataaatatttttttattttttatatatatatatcgtatcacc

SEQ ID NO: 583 - DNA, 66 bp, synthetic construct
  source 1..66: mol_type = other DNA
ggtgatcctttttatttttgatatataaatatttttttattttttatatatatatatcggatcacc

SEQ ID NO: 584 - DNA, 62 bp, synthetic construct
  source 1..62: mol_type = other DNA
gatacaaaaaaaaaaatatatatatatatataaaaaaaaaaaatatatatatatatagtatc

SEQ ID NO: 585 - DNA, 62 bp, synthetic construct
  source 1..62: mol_type = other DNA
gacacaaaaaaaaaaagatatatatatatataaaaaaaaaaaatatatatatatatcgtgtc

SEQ ID NO: 586 - DNA, 62 bp, synthetic construct
  source 1..62: mol_type = other DNA
gatatacaaaaaaaaaaatatatatatatataaaaaaaaaaaatatatatatatagtatatc

SEQ ID NO: 587 - DNA, 62 bp, synthetic construct
  source 1..62: mol_type = other DNA
gatatataaaaaaaaaaagatatatgtatataaaaaaaaaaaatatacatatatcatatatc

SEQ ID NO: 588 - DNA, 62 bp, synthetic construct
  source 1..62: mol_type = other DNA
gatatacaaaaaaaaaaagatatatatatataaaaaaaaaaaatatatatatatcgtatatc

SEQ ID NO: 589 - DNA, 62 bp, synthetic construct
  source 1..62: mol_type = other DNA
ggtatacaaaaaaaaaaatatatatatatataaaaaaaaaaaatatatatatatagtatacc

SEQ ID NO: 590 - DNA, 62 bp, synthetic construct
  source 1..62: mol_type = other DNA
gatatatcacaaaaaaaaaaatatatatataaaaaaaaaaaatatatatatagtgatatatc

SEQ ID NO: 591 - DNA, 62 bp, synthetic construct
  source 1..62: mol_type = other DNA
gtatatacataaaaaaaaaaagatatatgtaaaaaaaaaaaatacatatatcatgtatatac

SEQ ID NO: 592 - DNA, 62 bp, synthetic construct
  source 1..62: mol_type = other DNA
ggatatacataaaaaaaaaaagatatatgtaaaaaaaaaaaatacatatatcatgtatatcc

SEQ ID NO: 593 - DNA, 62 bp, synthetic construct
  source 1..62: mol_type = other DNA
ggatatacataaaaaaaaaaagatcatgtataaaaaaaaaaaatacatgatcatgtatatcc

SEQ ID NO: 594 - DNA, 62 bp, synthetic construct
  source 1..62: mol_type = other DNA
gggtatatacaaaaaaaaaaatatatatataaaaaaaaaaaatatatatatagtatataccc

SEQ ID NO: 595 - DNA, 68 bp, synthetic construct
  source 1..68: mol_type = other DNA
gtatatacaaaaaaaaaaatatatatatatatataaaaaaaaaaaatatatatatatatagtatatac

SEQ ID NO: 596 - DNA, 68 bp, synthetic construct
  source 1..68: mol_type = other DNA
gtatatacaaaaaaaaaaagatatatatatatataaaaaaaaaaaatatatatatatatcgtatatac

SEQ ID NO: 597 - DNA, 68 bp, synthetic construct
  source 1..68: mol_type = other DNA
ggatatacaaaaaaaaaaatatatatatatatataaaaaaaaaaaatatatatatatatagtatatcc

SEQ ID NO: 598 - DNA, 68 bp, synthetic construct
  source 1..68: mol_type = other DNA
ggatatacaaaaaaaaaaagatatatatatatataaaaaaaaaaaatatatatatatatcgtatatcc

SEQ ID NO: 599 - DNA, 66 bp, synthetic construct
  source 1..66: mol_type = other DNA
gtatatacaaaaaaaaaaatatatatatatataaaaaaaaaaaatatatatatatatagtatatac

SEQ ID NO: 600 - DNA, 66 bp, synthetic construct
  source 1..66: mol_type = other DNA
gtatatacaaaaaaaaaaagatatatatatataaaaaaaaaaaatatatatatatatcgtatatac

SEQ ID NO: 601 - DNA, 66 bp, synthetic construct
  source 1..66: mol_type = other DNA
ggatatacaaaaaaaaaaatatatatatatataaaaaaaaaaaatatatatatatatagtatatcc

SEQ ID NO: 602 - DNA, 66 bp, synthetic construct
  source 1..66: mol_type = other DNA
ggatatacaaaaaaaaaaagatatatatatataaaaaaaaaaaatatatatatatatcgtatatcc

SEQ ID NO: 603 - DNA, 66 bp, synthetic construct
  source 1..66: mol_type = other DNA
gatatatcacaaaaaaaaaaatatatatatataaaaaaaaaaaatatatatatatagtgatatatc

SEQ ID NO: 604 - DNA, 66 bp, synthetic construct
  source 1..66: mol_type = other DNA
ggatatacataaaaaaaaaaagatatatatataaaaaaaaaaaatatatatatatcatgtatatcc

SEQ ID NO: 605 - DNA, 64 bp, synthetic construct
  source 1..64: mol_type = other DNA
gtacatatattaaaaaaaaaaagatatatataaaaaaaaaaaatatatatatcaatatatgtac

SEQ ID NO: 606 - DNA, 64 bp, synthetic construct
  source 1..64: mol_type = other DNA
gatgtatatacaaaaaaaaaaatatatatataaaaaaaaaaaatatatatatagtatatacatc

SEQ ID NO: 607 - DNA, 66 bp, synthetic construct
  source 1..66: mol_type = other DNA
cgatcatatattaaaaaaaaaaagatatatataaaaaaaaaaaatatatatatcaatatatgatcg

SEQ ID NO: 608 - DNA, 66 bp, synthetic construct
  source 1..66: mol_type = other DNA
cgatcatatattaaaaaaaaaaagatatatgtaaaaaaaaaaaatacatatatcaatatatgatcg

SEQ ID NO: 609 - DNA, 62 bp, synthetic construct
  source 1..62: mol_type = other DNA
gatacaaaaaaaaaaatataaatatatatataaaaaaaaaaaatatatatatatatagtatc

SEQ ID NO: 610 - DNA, 62 bp, synthetic construct
  source 1..62: mol_type = other DNA
ggatcaaaaaaaaaaatataaatatatatataaaaaaaaaaaatatatatatatatagatcc

SEQ ID NO: 611 - DNA, 62 bp, synthetic construct
  source 1..62: mol_type = other DNA
gacacaaaaaaaaaaagataaatatatatataaaaaaaaaaaatatatatatatatcgtgtc

SEQ ID NO: 612 - DNA, 62 bp, synthetic construct
  source 1..62: mol_type = other DNA
gacacaaaaaaaaaaagatgatgtatatataaaaaaaaaaaatatatatacatgatcgtgtc

SEQ ID NO: 613 - DNA, 62 bp, synthetic construct
  source 1..62: mol_type = other DNA
gcgtcaaaaaaaaaaagataaatatatatataaaaaaaaaaaatatatatatatatcgacgc

SEQ ID NO: 614 - DNA, 62 bp, synthetic construct
  source 1..62: mol_type = other DNA
gatatacaaaaaaaaaaatataaatatatataaaaaaaaaaaatatatatatatagtatatc

SEQ ID NO: 615 - DNA, 62 bp, synthetic construct
  source 1..62: mol_type = other DNA
gtatatacataaaaaaaaaaagataaatgtaaaaaaaaaaaatacatatatcatgtatatac

SEQ ID NO: 616 - DNA, 62 bp, synthetic construct
  source 1..62: mol_type = other DNA
gtatatacataaaaaaaaaaagatgatatataaaaaaaaaaaatatatgatcatgtatatac

SEQ ID NO: 617 - DNA, 62 bp, synthetic construct
  source 1..62: mol_type = other DNA
ggatatacataaaaaaaaaaagataaatataaaaaaaaaaaatatatatatcatgtatatcc

SEQ ID NO: 618 - DNA, 62 bp, synthetic construct
  source 1..62: mol_type = other DNA
ggatatacataaaaaaaaaaagatgatatataaaaaaaaaaaatatatgatcatgtatatcc

SEQ ID NO: 619 - DNA, 68 bp, synthetic construct
  source 1..68: mol_type = other DNA
gtatatacaaaaaaaaaaatataaatatatatataaaaaaaaaaaatatatatatatatagtatatac

SEQ ID NO: 620 - DNA, 68 bp, synthetic construct
  source 1..68: mol_type = other DNA
gtatatacaaaaaaaaaaagataaatatatatataaaaaaaaaaaatatatatatatatcgtatatac

SEQ ID NO: 621 - DNA, 68 bp, synthetic construct
  source 1..68: mol_type = other DNA
ggatatacaaaaaaaaaaatataaatatatatataaaaaaaaaaaatatatatatatatagtatatcc

SEQ ID NO: 622 - DNA, 68 bp, synthetic construct
  source 1..68: mol_type = other DNA
ggatatacaaaaaaaaaaagataaatatatatataaaaaaaaaaaatatatatatatatcgtatatcc

SEQ ID NO: 623 - DNA, 66 bp, synthetic construct
  source 1..66: mol_type = other DNA
gtatatacaaaaaaaaaaagataaatgtatataaaaaaaaaaaatatatacatatatcgtatatac

SEQ ID NO: 624 - DNA, 66 bp, synthetic construct
  source 1..66: mol_type = other DNA
ggatatacaaaaaaaaaaagataaatgtatataaaaaaaaaaaatatatacatatatcgtatatcc

SEQ ID NO: 625 - DNA, 66 bp, synthetic construct
  source 1..66: mol_type = other DNA
ggtgatacaaaaaaaaaaagatgatgtatatataaaaaaaaaaaatatatacatgatcgtatcacc

SEQ ID NO: 626 - DNA, 68 bp, synthetic construct
  source 1..68: mol_type = other DNA
gatatatcacaaaaaaaaaaatataaatatatataaaaaaaaaaaatatatatatatagtgatatatc

SEQ ID NO: 627 - DNA, 66 bp, synthetic construct
  source 1..66: mol_type = other DNA
gtatatacataaaaaaaaaaagataaatatataaaaaaaaaaaatatatatatatcatgtatatac

SEQ ID NO: 628 - DNA, 66 bp, synthetic construct
  source 1..66: mol_type = other DNA
gtatatacataaaaaaaaaaagatgatatatgtaaaaaaaaaaaacatatatgatcatgtatatac

SEQ ID NO: 629 - DNA, 66 bp, synthetic construct
  source 1..66: mol_type = other DNA
ggatatacataaaaaaaaaaagataaatatataaaaaaaaaaaatatatatatatcatgtatatcc

SEQ ID NO: 630 - DNA, 64 bp, synthetic construct
  source 1..64: mol_type = other DNA
gtacatatattaaaaaaaaaaagataaatataaaaaaaaaaaatatatatatcaatatatgtac

SEQ ID NO: 631 - DNA, 64 bp, synthetic construct
  source 1..64: mol_type = other DNA
gtacatatattaaaaaaaaaaagataaatgtaaaaaaaaaaaatacatatatcaatatatgtac

SEQ ID NO: 632 - DNA, 64 bp, synthetic construct
  source 1..64: mol_type = other DNA
gtacatatattaaaaaaaaaaagatgatatataaaaaaaaaaaatatatgatcaatatatgtac

SEQ ID NO: 633 - DNA, 62 bp, synthetic construct
  source 1..62: mol_type = other DNA
ggatatacataaaaaaaaaaagatgatgaataaaaaaaaaaaatacatgatcatgtatatcc

SEQ ID NO: 634 - DNA, 62 bp, synthetic construct
  source 1..62: mol_type = other DNA
gtatatacataaaaaaaaaaagataaatgttaaaaaaaaaaatacatatatcatgtatatac

SEQ ID NO: 635 - DNA, 62 bp, synthetic construct
  source 1..62: mol_type = other DNA
gatacaaaaaaaaaaagatataaatatataaaaaaaaaaaaaatatatatatatatcgtatc

SEQ ID NO: 636 - DNA, 62 bp, synthetic construct
  source 1..62: mol_type = other DNA
gatacaaaaaaaaaaagatgatataagtactaaaaaaaaaaaagtacatatatgatcgtatc

SEQ ID NO: 637 - DNA, 62 bp, synthetic construct
  source 1..62: mol_type = other DNA
gacacaaaaaaaaaaagataaatgaatatataaaaaaaaaaaatatatacatatatcgtgtc

SEQ ID NO: 638 - DNA, 68 bp, synthetic construct
  source 1..68: mol_type = other DNA
ggatatacaaaaaaaaaaagatataagtaaatataaaaaaaaaaaatatatacatatatcgtatatcc

SEQ ID NO: 639 - DNA, 68 bp, synthetic construct
  source 1..68: mol_type = other DNA
ggatatacaaaaaaaaaaagatgatataagtactaaaaaaaaaaaagtacatatatgatcgtatatcc

SEQ ID NO: 640 - DNA, 68 bp, synthetic construct
  source 1..68: mol_type = other DNA
gtatatacaaaaaaaaaaagatataagtaaatataaaaaaaaaaaatatatacatatatcgtatatac

SEQ ID NO: 641 - DNA, 68 bp, synthetic construct
  source 1..68: mol_type = other DNA
gtatatacaaaaaaaaaaagatgatataagtactaaaaaaaaaaaagtacatatatgatcgtatatac

SEQ ID NO: 642 - DNA, 66 bp, synthetic construct
  source 1..66: mol_type = other DNA
ggatatacaaaaaaaaaaagataaatgaatataaaaaaaaaaaatatatacatatatcgtatatcc

SEQ ID NO: 643 - DNA, 66 bp, synthetic construct
  source 1..66: mol_type = other DNA
gtatatacaaaaaaaaaaagataaatgaatataaaaaaaaaaaatatatacatatatcgtatatac

SEQ ID NO: 644 - DNA, 66 bp, synthetic construct
  source 1..66: mol_type = other DNA
gtatatacaaaaaaaaaaagatgatataagtacaaaaaaaaaaagtacatatatgatcgtatatac

SEQ ID NO: 645 - DNA, 66 bp, synthetic construct
  source 1..66: mol_type = other DNA
gtatatacaaaaaaaaaaatataaatatatattaaaaaaaaaaatatatatatatatagtatatac

SEQ ID NO: 646 - DNA, 70 bp, synthetic construct
  source 1..70: mol_type = other DNA
gtatatacataaaaaaaaaaagatgatgtaaatataaaaaaaaaaaatatatacatgatcatgtatatac

SEQ ID NO: 647 - DNA, 62 bp, synthetic construct
  source 1..62: mol_type = other DNA
gatatacaaaaaaaaaaagataaatatataaaaaaaaaaaaaatatatatatatcgtatatc

SEQ ID NO: 648 - DNA, 62 bp, synthetic construct
  source 1..62: mol_type = other DNA
gtgatacaaaaaaaaaaagataaatatataaaaaaaaaaaaaatatatatatatcgtatcac

SEQ ID NO: 649 - DNA, 62 bp, synthetic construct
  source 1..62: mol_type = other DNA
ggtatacaaaaaaaaaaagataaatatataaaaaaaaaaaaaatatatatatatcgtatacc

SEQ ID NO: 650 - DNA, 66 bp, synthetic construct
  source 1..66: mol_type = other DNA
ggatatacataaaaaaaaaaagataaatgaataaaaaaaaaaaatatacatatatcatgtatatcc

SEQ ID NO: 651 - DNA, 66 bp, synthetic construct
  source 1..66: mol_type = other DNA
gtatatacataaaaaaaaaaagataaatgtattaaaaaaaaaaatatacatatatcatgtatatac

SEQ ID NO: 652 - DNA, 66 bp, synthetic construct
  source 1..66: mol_type = other DNA
gtatatacataaaaaaaaaaagatgataaatgtaaaaaaaaaaaacatatatgatcatgtatatac

SEQ ID NO: 653 - DNA, 62 bp, synthetic construct; identical to SEQ ID NO: 14
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Guanosine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Thymine phosphorothioate

SEQ ID NO: 654 - DNA, 62 bp, synthetic construct; identical to SEQ ID NO: 15
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Guanosine phosphorothioate
  modified_base 59: mod_base = OTHER; note = Thymine phosphorothioate
  modified_base 60: mod_base = OTHER; note = Guanosine phosphorothioate
  modified_base 61: mod_base = OTHER; note = Thymine phosphorothioate

SEQ ID NO: 655 - DNA, 62 bp, synthetic construct; identical to SEQ ID NO: 16
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Cytosine phosphorothioate
  modified_base 58: mod_base = OTHER; note = Guanosine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Thymine phosphorothioate

SEQ ID NO: 656 - DNA, 62 bp, synthetic construct; identical to SEQ ID NO: 17
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Guanosine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Cytosine phosphorothioate

SEQ ID NO: 657 - DNA, 62 bp, synthetic construct; identical to SEQ ID NO: 18
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Cytosine phosphorothioate
  modified_base 58: mod_base = OTHER; note = Guanosine phosphorothioate
  modified_base 59: mod_base = OTHER; note = Thymine phosphorothioate
  modified_base 60: mod_base = OTHER; note = Guanosine phosphorothioate
  modified_base 61: mod_base = OTHER; note = Thymine phosphorothioate

SEQ ID NO: 658 - DNA, 62 bp, synthetic construct; identical to SEQ ID NO: 19
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Cytosine phosphorothioate
  modified_base 58: mod_base = OTHER; note = Guanosine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Cytosine phosphorothioate

SEQ ID NO: 659 - DNA, 62 bp, synthetic construct; identical to SEQ ID NO: 20
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Guanosine phosphorothioate
  modified_base 59: mod_base = OTHER; note = Adenine phosphorothioate
  modified_base 60: mod_base = OTHER; note = Cytosine phosphorothioate
  modified_base 61: mod_base = OTHER; note = Guanosine phosphorothioate

SEQ ID NO: 660 - DNA, 62 bp, synthetic construct; identical to SEQ ID NO: 21
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Cytosine phosphorothioate
  modified_base 58: mod_base = OTHER; note = Guanosine phosphorothioate
  modified_base 59: mod_base = OTHER; note = Adenine phosphorothioate
  modified_base 60: mod_base = OTHER; note = Cytosine phosphorothioate
  modified_base 61: mod_base = OTHER; note = Guanosine phosphorothioate

SEQ ID NO: 661 - DNA, 62 bp, synthetic construct; identical to SEQ ID NO: 22
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Guanosine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Adenine phosphorothioate

SEQ ID NO: 662 - DNA, 62 bp, synthetic construct; identical to SEQ ID NO: 23
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Guanosine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Adenine phosphorothioate

SEQ ID NO: 663 - DNA, 62 bp, synthetic construct; identical to SEQ ID NO: 24
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Cytosine phosphorothioate
  modified_base 57: mod_base = OTHER; note = Guanosine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Adenine phosphorothioate

SEQ ID NO: 664 - DNA, 62 bp, synthetic construct; identical to SEQ ID NO: 25
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Cytosine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Cytosine phosphorothioate
  modified_base 57: mod_base = OTHER; note = Guanosine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Adenine phosphorothioate

SEQ ID NO: 665 - DNA, 62 bp, synthetic construct; identical to SEQ ID NO: 26
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Guanosine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Cytosine phosphorothioate

SEQ ID NO: 666 - DNA, 62 bp, synthetic construct; identical to SEQ ID NO: 27
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Cytosine phosphorothioate
  modified_base 57: mod_base = OTHER; note = Guanosine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Adenine phosphorothioate

SEQ ID NO: 667 - DNA, 62 bp, synthetic construct; identical to SEQ ID NO: 28
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Cytosine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Cytosine phosphorothioate
  modified_base 57: mod_base = OTHER; note = Guanosine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Adenine phosphorothioate

SEQ ID NO: 668 - DNA, 62 bp, synthetic construct; identical to SEQ ID NO: 29
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Cytosine phosphorothioate
  modified_base 57: mod_base = OTHER; note = Guanosine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Cytosine phosphorothioate

SEQ ID NO: 669 - DNA, 62 bp, synthetic construct; identical to SEQ ID NO: 30
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Cytosine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Cytosine phosphorothioate
  modified_base 57: mod_base = OTHER; note = Guanosine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Cytosine phosphorothioate

SEQ ID NO: 670 - DNA, 62 bp, synthetic construct; identical to SEQ ID NO: 31
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Guanosine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Guanosine phosphorothioate

SEQ ID NO: 671 - DNA, 62 bp, synthetic construct; identical to SEQ ID NO: 32
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Cytosine phosphorothioate
  modified_base 57: mod_base = OTHER; note = Guanosine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Guanosine phosphorothioate

SEQ ID NO: 672 - DNA, 62 bp, synthetic construct; identical to SEQ ID NO: 33
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Cytosine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Cytosine phosphorothioate
  modified_base 57: mod_base = OTHER; note = Guanosine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Guanosine phosphorothioate

SEQ ID NO: 673 - DNA, 62 bp, synthetic construct; identical to SEQ ID NO: 34
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Adenine phosphorothioate
  modified_base 56: mod_base = OTHER; note = Guanosine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Thymine phosphorothioate

SEQ ID NO: 674 - DNA, 62 bp, synthetic construct; identical to SEQ ID NO: 35
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Cytosine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Thymine phosphorothioate

SEQ ID NO: 675 - DNA, 62 bp, synthetic construct; identical to SEQ ID NO: 36
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Cytosine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Cytosine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Thymine phosphorothioate

SEQ ID NO: 676 - DNA, 62 bp, synthetic construct; identical to SEQ ID NO: 37
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Adenine phosphorothioate
  modified_base 56: mod_base = OTHER; note = Guanosine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Adenine phosphorothioate

SEQ ID NO: 677 - DNA, 62 bp, synthetic construct; identical to SEQ ID NO: 38
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Cytosine phosphorothioate
  modified_base 56: mod_base = OTHER; note = Guanosine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Thymine phosphorothioate

SEQ ID NO: 678 - DNA, 62 bp, synthetic construct; identical to SEQ ID NO: 39
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Cytosine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Cytosine phosphorothioate
  modified_base 56: mod_base = OTHER; note = Guanosine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Thymine phosphorothioate

SEQ ID NO: 679 - DNA, 62 bp, synthetic construct; identical to SEQ ID NO: 40
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Adenine phosphorothioate
  modified_base 56: mod_base = OTHER; note = Guanosine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Cytosine phosphorothioate

SEQ ID NO: 680 - DNA, 62 bp, synthetic construct; identical to SEQ ID NO: 41
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Cytosine phosphorothioate
  modified_base 56: mod_base = OTHER; note = Guanosine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Adenine phosphorothioate

SEQ ID NO: 681 - DNA, 62 bp, synthetic construct; identical to SEQ ID NO: 42
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Cytosine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Cytosine phosphorothioate
  modified_base 56: mod_base = OTHER; note = Guanosine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Adenine phosphorothioate

SEQ ID NO: 682 - DNA, 62 bp, synthetic construct; identical to SEQ ID NO: 43
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Cytosine phosphorothioate
  modified_base 56: mod_base = OTHER; note = Guanosine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Cytosine phosphorothioate

SEQ ID NO: 683 - DNA, 62 bp, synthetic construct; identical to SEQ ID NO: 44
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Cytosine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Cytosine phosphorothioate
  modified_base 56: mod_base = OTHER; note = Guanosine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Cytosine phosphorothioate

SEQ ID NO: 684 - DNA, 62 bp, synthetic construct; identical to SEQ ID NO: 45
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Adenine phosphorothioate
  modified_base 56: mod_base = OTHER; note = Guanosine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Cytosine phosphorothioate
  modified_base 60: mod_base = OTHER; note = Adenine phosphorothioate
  modified_base 61: mod_base = OTHER; note = Cytosine phosphorothioate

SEQ ID NO: 685 - DNA, 62 bp, synthetic construct; identical to SEQ ID NO: 46
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Cytosine phosphorothioate
  modified_base 56: mod_base = OTHER; note = Guanosine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Cytosine phosphorothioate
  modified_base 60: mod_base = OTHER; note = Adenine phosphorothioate
  modified_base 61: mod_base = OTHER; note = Cytosine phosphorothioate

SEQ ID NO: 686 - DNA, 62 bp, synthetic construct; identical to SEQ ID NO: 47
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Cytosine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Cytosine phosphorothioate
  modified_base 56: mod_base = OTHER; note = Guanosine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Cytosine phosphorothioate
  modified_base 60: mod_base = OTHER; note = Adenine phosphorothioate
  modified_base 61: mod_base = OTHER; note = Cytosine phosphorothioate

SEQ ID NO: 687 - DNA, 62 bp, synthetic construct; identical to SEQ ID NO: 48
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Guanosine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Adenine phosphorothioate

SEQ ID NO: 688 - DNA, 62 bp, synthetic construct; identical to SEQ ID NO: 49
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Cytosine phosphorothioate
  modified_base 55: mod_base = OTHER; note = Guanosine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Adenine phosphorothioate

SEQ ID NO: 689 - DNA, 62 bp, synthetic construct; identical to SEQ ID NO: 50
  source 1..62: mol_type = other DNA
  modified_base 46: mod_base = OTHER; note = Adenine phosphorothioate
  modified_base 47: mod_base = OTHER; note = Cytosine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Cytosine phosphorothioate
  modified_base 55: mod_base = OTHER; note = Guanosine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Adenine phosphorothioate

SEQ ID NO: 690 - DNA, 62 bp, synthetic construct; identical to SEQ ID NO: 51
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Cytosine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Guanosine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Cytosine phosphorothioate
  modified_base 55: mod_base = OTHER; note = Guanosine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Adenine phosphorothioate

SEQ ID NO: 691 - DNA, 62 bp, synthetic construct; identical to SEQ ID NO: 52
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Guanosine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Cytosine phosphorothioate
  modified_base 55: mod_base = OTHER; note = Guanosine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Adenine phosphorothioate

SEQ ID NO: 692 - DNA, 62 bp, synthetic construct; identical to SEQ ID NO: 53
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Guanosine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Cytosine phosphorothioate

SEQ ID NO: 693 - DNA, 62 bp, synthetic construct; identical to SEQ ID NO: 54
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Cytosine phosphorothioate
  modified_base 55: mod_base = OTHER; note = Guanosine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Cytosine phosphorothioate

SEQ ID NO: 694 - DNA, 62 bp, synthetic construct; identical to SEQ ID NO: 55
  source 1..62: mol_type = other DNA
  modified_base 46: mod_base = OTHER; note = Adenine phosphorothioate
  modified_base 47: mod_base = OTHER; note = Cytosine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Cytosine phosphorothioate
  modified_base 55: mod_base = OTHER; note = Guanosine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Cytosine phosphorothioate

SEQ ID NO: 695 - DNA, 62 bp, synthetic construct; identical to SEQ ID NO: 56
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Cytosine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Guanosine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Cytosine phosphorothioate
  modified_base 55: mod_base = OTHER; note = Guanosine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Cytosine phosphorothioate

SEQ ID NO: 696 - DNA, 62 bp, synthetic construct; identical to SEQ ID NO: 57
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Guanosine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Cytosine phosphorothioate
  modified_base 55: mod_base = OTHER; note = Guanosine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Cytosine phosphorothioate

SEQ ID NO: 697 - DNA, 62 bp, synthetic construct; identical to SEQ ID NO: 58
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Guanosine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Cytosine phosphorothioate
  modified_base 60: mod_base = OTHER; note = Adenine phosphorothioate
  modified_base 61: mod_base = OTHER; note = Cytosine phosphorothioate

SEQ ID NO: 698 - DNA, 62 bp, synthetic construct; identical to SEQ ID NO: 59
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Cytosine phosphorothioate
  modified_base 55: mod_base = OTHER; note = Guanosine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Cytosine phosphorothioate
  modified_base 60: mod_base = OTHER; note = Adenine phosphorothioate
  modified_base 61: mod_base = OTHER; note = Cytosine phosphorothioate

SEQ ID NO: 699 - DNA, 62 bp, synthetic construct; identical to SEQ ID NO: 60
  source 1..62: mol_type = other DNA
  modified_base 46: mod_base = OTHER; note = Adenine phosphorothioate
  modified_base 47: mod_base = OTHER; note = Cytosine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Cytosine phosphorothioate
  modified_base 55: mod_base = OTHER; note = Guanosine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Cytosine phosphorothioate
  modified_base 60: mod_base = OTHER; note = Adenine phosphorothioate
  modified_base 61: mod_base = OTHER; note = Cytosine phosphorothioate

SEQ ID NO: 700 - DNA, 62 bp, synthetic construct; identical to SEQ ID NO: 61
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Cytosine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Guanosine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Cytosine phosphorothioate
  modified_base 55: mod_base = OTHER; note = Guanosine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Cytosine phosphorothioate
  modified_base 60: mod_base = OTHER; note = Adenine phosphorothioate
  modified_base 61: mod_base = OTHER; note = Cytosine phosphorothioate

SEQ ID NO: 701 - DNA, 62 bp, synthetic construct; identical to SEQ ID NO: 62
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Guanosine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Cytosine phosphorothioate
  modified_base 55: mod_base = OTHER; note = Guanosine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Cytosine phosphorothioate
  modified_base 60: mod_base = OTHER; note = Adenine phosphorothioate
  modified_base 61: mod_base = OTHER; note = Cytosine phosphorothioate

SEQ ID NO: 702 - DNA, 62 bp, synthetic construct; identical to SEQ ID NO: 63
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Guanosine phosphorothioate
  modified_base 56: mod_base = OTHER; note = Guanosine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Cytosine phosphorothioate
  modified_base 60: mod_base = OTHER; note = Adenine phosphorothioate
  modified_base 61: mod_base = OTHER; note = Cytosine phosphorothioate

SEQ ID NO: 703 - DNA, 62 bp, synthetic construct; identical to SEQ ID NO: 64
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Cytosine phosphorothioate
  modified_base 55: mod_base = OTHER; note = Guanosine phosphorothioate
  modified_base 56: mod_base = OTHER; note = Guanosine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Cytosine phosphorothioate
  modified_base 60: mod_base = OTHER; note = Adenine phosphorothioate
  modified_base 61: mod_base = OTHER; note = Cytosine phosphorothioate

SEQ ID NO: 704 - DNA, 62 bp, synthetic construct; identical to SEQ ID NO: 65
  source 1..62: mol_type = other DNA
  modified_base 46: mod_base = OTHER; note = Adenine phosphorothioate
  modified_base 47: mod_base = OTHER; note = Cytosine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Cytosine phosphorothioate
  modified_base 55: mod_base = OTHER; note = Guanosine phosphorothioate
  modified_base 56: mod_base = OTHER; note = Guanosine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Cytosine phosphorothioate
  modified_base 60: mod_base = OTHER; note = Adenine phosphorothioate
  modified_base 61: mod_base = OTHER; note = Cytosine phosphorothioate

SEQ ID NO: 705 - DNA, 62 bp, synthetic construct; identical to SEQ ID NO: 66
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Cytosine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Guanosine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Cytosine phosphorothioate
  modified_base 55: mod_base = OTHER; note = Guanosine phosphorothioate
  modified_base 56: mod_base = OTHER; note = Guanosine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Cytosine phosphorothioate
  modified_base 60: mod_base = OTHER; note = Adenine phosphorothioate
  modified_base 61: mod_base = OTHER; note = Cytosine phosphorothioate

SEQ ID NO: 706 - DNA, 62 bp, synthetic construct; identical to SEQ ID NO: 67
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Guanosine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Cytosine phosphorothioate
  modified_base 55: mod_base = OTHER; note = Guanosine phosphorothioate
  modified_base 56: mod_base = OTHER; note = Guanosine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Cytosine phosphorothioate
  modified_base 60: mod_base = OTHER; note = Adenine phosphorothioate
  modified_base 61: mod_base = OTHER; note = Cytosine phosphorothioate

SEQ ID NO: 707 - DNA, 62 bp, synthetic construct; identical to SEQ ID NO: 68
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Guanosine phosphorothioate
  modified_base 54: mod_base = OTHER; note = Thymine phosphorothioate
  modified_base 55: mod_base = OTHER; note = Guanosine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Thymine phosphorothioate

SEQ ID NO: 708 - DNA, 62 bp, synthetic construct; identical to SEQ ID NO: 69
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Cytosine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Guanosine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Adenine phosphorothioate

SEQ ID NO: 709 - DNA, 62 bp, synthetic construct; identical to SEQ ID NO: 70
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Cytosine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Guanosine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Adenine phosphorothioate

SEQ ID NO: 710 - DNA, 62 bp, synthetic construct; identical to SEQ ID NO: 71
  source 1..62: mol_type = other DNA
  modified_base 46: mod_base = OTHER; note = Cytosine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Guanosine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Cytosine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Guanosine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Adenine phosphorothioate

SEQ ID NO: 711 - DNA, 62 bp, synthetic construct; identical to SEQ ID NO: 72
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Guanosine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Cytosine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Guanosine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Adenine phosphorothioate

SEQ ID NO: 712 - DNA, 62 bp, synthetic construct; identical to SEQ ID NO: 73
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Guanosine phosphorothioate
  modified_base 54: mod_base = OTHER; note = Thymine phosphorothioate
  modified_base 55: mod_base = OTHER; note = Guanosine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Cytosine phosphorothioate

SEQ ID NO: 713 - DNA, 62 bp, synthetic construct; identical to SEQ ID NO: 74
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Cytosine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Guanosine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Cytosine phosphorothioate

SEQ ID NO: 714 - DNA, 62 bp, synthetic construct; identical to SEQ ID NO: 75
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Cytosine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Guanosine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Cytosine phosphorothioate

SEQ ID NO: 715 - DNA, 62 bp, synthetic construct; identical to SEQ ID NO: 76
  source 1..62: mol_type = other DNA
  modified_base 46: mod_base = OTHER; note = Cytosine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Guanosine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Cytosine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Guanosine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Cytosine phosphorothioate

SEQ ID NO: 716 - DNA, 62 bp, synthetic construct; identical to SEQ ID NO: 77
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Guanosine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Cytosine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Guanosine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Cytosine phosphorothioate

SEQ ID NO: 717 - DNA, 62 bp, synthetic construct; identical to SEQ ID NO: 78
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Guanosine phosphorothioate
  modified_base 54: mod_base = OTHER; note = Thymine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Cytosine phosphorothioate
  modified_base 61: mod_base = OTHER; note = Cytosine phosphorothioate

SEQ ID NO: 718 - DNA, 62 bp, synthetic construct; identical to SEQ ID NO: 79
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Cytosine phosphorothioate
  modified_base 53: mod_base = OTHER; note = Guanosine phosphorothioate
  modified_base 54: mod_base = OTHER; note = Thymine phosphorothioate
  modified_base 55: mod_base = OTHER; note = Guanosine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Cytosine phosphorothioate

SEQ ID NO: 719 - DNA, 62 bp, synthetic construct; identical to SEQ ID NO: 80
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Cytosine phosphorothioate
  modified_base 53: mod_base = OTHER; note = Guanosine phosphorothioate
  modified_base 54: mod_base = OTHER; note = Thymine phosphorothioate
  modified_base 55: mod_base = OTHER; note = Guanosine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Cytosine phosphorothioate

SEQ ID NO: 720 - DNA, 62 bp, synthetic construct; identical to SEQ ID NO: 81
  source 1..62: mol_type = other DNA
  modified_base 46: mod_base = OTHER; note = Cytosine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Guanosine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Cytosine phosphorothioate
  modified_base 53: mod_base = OTHER; note = Guanosine phosphorothioate
  modified_base 54: mod_base = OTHER; note = Thymine phosphorothioate
  modified_base 55: mod_base = OTHER; note = Guanosine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Cytosine phosphorothioate

SEQ ID NO: 721 - DNA, 62 bp, synthetic construct; identical to SEQ ID NO: 82
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Guanosine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Cytosine phosphorothioate
  modified_base 53: mod_base = OTHER; note = Guanosine phosphorothioate
  modified_base 54: mod_base = OTHER; note = Thymine phosphorothioate
  modified_base 55: mod_base = OTHER; note = Guanosine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Cytosine phosphorothioate

SEQ ID NO: 722 - DNA, 62 bp, synthetic construct; identical to SEQ ID NO: 83
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Cytosine phosphorothioate
  modified_base 53: mod_base = OTHER; note = Guanosine phosphorothioate
  modified_base 54: mod_base = OTHER; note = Thymine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Cytosine phosphorothioate
  modified_base 61: mod_base = OTHER; note = Cytosine phosphorothioate

SEQ ID NO: 723 - DNA, 62 bp, synthetic construct; identical to SEQ ID NO: 84
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Cytosine phosphorothioate
  modified_base 53: mod_base = OTHER; note = Guanosine phosphorothioate
  modified_base 54: mod_base = OTHER; note = Thymine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Cytosine phosphorothioate
  modified_base 61: mod_base = OTHER; note = Cytosine phosphorothioate

SEQ ID NO: 724 - DNA, 62 bp, synthetic construct; identical to SEQ ID NO: 85
  source 1..62: mol_type = other DNA
  modified_base 46: mod_base = OTHER; note = Cytosine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Guanosine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Cytosine phosphorothioate
  modified_base 53: mod_base = OTHER; note = Guanosine phosphorothioate
  modified_base 54: mod_base = OTHER; note = Thymine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Cytosine phosphorothioate
  modified_base 61: mod_base = OTHER; note = Cytosine phosphorothioate

SEQ ID NO: 725 - DNA, 62 bp, synthetic construct; identical to SEQ ID NO: 86
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Guanosine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Cytosine phosphorothioate
  modified_base 53: mod_base = OTHER; note = Guanosine phosphorothioate
  modified_base 54: mod_base = OTHER; note = Thymine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Cytosine phosphorothioate
  modified_base 61: mod_base = OTHER; note = Cytosine phosphorothioate

SEQ ID NO: 726 - DNA, 62 bp, synthetic construct; identical to SEQ ID NO: 87
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Guanosine phosphorothioate
  modified_base 54: mod_base = OTHER; note = Thymine phosphorothioate
  modified_base 55: mod_base = OTHER; note = Guanosine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Cytosine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Cytosine phosphorothioate

SEQ ID NO: 727 - DNA, 62 bp, synthetic construct; identical to SEQ ID NO: 88
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Cytosine phosphorothioate
  modified_base 53: mod_base = OTHER; note = Guanosine phosphorothioate
  modified_base 54: mod_base = OTHER; note = Thymine phosphorothioate
  modified_base 55: mod_base = OTHER; note = Guanosine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Cytosine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Cytosine phosphorothioate

SEQ ID NO: 728 - DNA, 62 bp, synthetic construct; identical to SEQ ID NO: 89
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Cytosine phosphorothioate
  modified_base 53: mod_base = OTHER; note = Guanosine phosphorothioate
  modified_base 54: mod_base = OTHER; note = Thymine phosphorothioate
  modified_base 55: mod_base = OTHER; note = Guanosine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Cytosine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Cytosine phosphorothioate

SEQ ID NO: 729 - DNA, 62 bp, synthetic construct; identical to SEQ ID NO: 90
  source 1..62: mol_type = other DNA
  modified_base 46: mod_base = OTHER; note = Cytosine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Guanosine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Cytosine phosphorothioate
  modified_base 53: mod_base = OTHER; note = Guanosine phosphorothioate
  modified_base 54: mod_base = OTHER; note = Thymine phosphorothioate
  modified_base 55: mod_base = OTHER; note = Guanosine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Cytosine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Cytosine phosphorothioate

SEQ ID NO: 730 - DNA, 62 bp, synthetic construct; identical to SEQ ID NO: 91
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Guanosine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Cytosine phosphorothioate
  modified_base 53: mod_base = OTHER; note = Guanosine phosphorothioate
  modified_base 54: mod_base = OTHER; note = Thymine phosphorothioate
  modified_base 55: mod_base = OTHER; note = Guanosine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Cytosine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Cytosine phosphorothioate

SEQ ID NO: 731 - DNA, 68 bp, synthetic construct; identical to SEQ ID NO: 92
  source 1..68: mol_type = other DNA
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Guanosine phosphorothioate
  modified_base 62: mod_base = OTHER; note = Thymine phosphorothioate
  modified_base 63: mod_base = OTHER; note = Adenine phosphorothioate
  modified_base 64: mod_base = OTHER; note = Thymine phosphorothioate

SEQ ID NO: 732 - DNA, 68 bp, synthetic construct; identical to SEQ ID NO: 93
  source 1..68: mol_type = other DNA
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Guanosine phosphorothioate
  modified_base 62: mod_base = OTHER; note = Thymine phosphorothioate
  modified_base 63: mod_base = OTHER; note = Adenine phosphorothioate
  modified_base 64: mod_base = OTHER; note = Thymine phosphorothioate

SEQ ID NO: 733 - DNA, 68 bp, synthetic construct; identical to SEQ ID NO: 94
  source 1..68: mol_type = other DNA
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Guanosine phosphorothioate
  modified_base 62: mod_base = OTHER; note = Thymine phosphorothioate
  modified_base 63: mod_base = OTHER; note = Adenine phosphorothioate
  modified_base 64: mod_base = OTHER; note = Thymine phosphorothioate

SEQ ID NO: 734 - DNA, 68 bp, synthetic construct; identical to SEQ ID NO: 95
  source 1..68: mol_type = other DNA
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Guanosine phosphorothioate
  modified_base 62: mod_base = OTHER; note = Thymine phosphorothioate
  modified_base 63: mod_base = OTHER; note = Adenine phosphorothioate
  modified_base 64: mod_base = OTHER; note = Thymine phosphorothioate

SEQ ID NO: 735 - DNA, 68 bp, synthetic construct; identical to SEQ ID NO: 96
  source 1..68: mol_type = other DNA
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Guanosine phosphorothioate
  modified_base 62: mod_base = OTHER; note = Thymine phosphorothioate
  modified_base 63: mod_base = OTHER; note = Adenine phosphorothioate
  modified_base 64: mod_base = OTHER; note = Thymine phosphorothioate

SEQ ID NO: 736 - DNA, 68 bp, synthetic construct; identical to SEQ ID NO: 97
  source 1..68: mol_type = other DNA
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Guanosine phosphorothioate
  modified_base 62: mod_base = OTHER; note = Thymine phosphorothioate
  modified_base 63: mod_base = OTHER; note = Adenine phosphorothioate
  modified_base 64: mod_base = OTHER; note = Thymine phosphorothioate

SEQ ID NO: 737 - DNA, 68 bp, synthetic construct; identical to SEQ ID NO: 98
  source 1..68: mol_type = other DNA
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Guanosine phosphorothioate
  modified_base 62: mod_base = OTHER; note = Guanosine phosphorothioate
  modified_base 63: mod_base = OTHER; note = Adenine phosphorothioate
  modified_base 64: mod_base = OTHER; note = Thymine phosphorothioate

SEQ ID NO: 738 - DNA, 68 bp, synthetic construct; identical to SEQ ID NO: 99
  source 1..68: mol_type = other DNA
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Guanosine phosphorothioate
  modified_base 62: mod_base = OTHER; note = Guanosine phosphorothioate
  modified_base 63: mod_base = OTHER; note = Adenine phosphorothioate
  modified_base 64: mod_base = OTHER; note = Thymine phosphorothioate

SEQ ID NO: 739 - DNA, 72 bp, synthetic construct; identical to SEQ ID NO: 100
  source 1..72: mol_type = other DNA
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Thymine phosphorothioate
  modified_base 62: mod_base = OTHER; note = Adenine phosphorothioate
  modified_base 63: mod_base = OTHER; note = Guanosine phosphorothioate
  modified_base 64: mod_base = OTHER; note = Thymine phosphorothioate
  modified_base 65: mod_base = OTHER; note = Guanosine phosphorothioate
  modified_base 66: mod_base = OTHER; note = Adenine phosphorothioate

SEQ ID NO: 740 - DNA, 72 bp, synthetic construct; identical to SEQ ID NO: 101
  source 1..72: mol_type = other DNA
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Thymine phosphorothioate
  modified_base 62: mod_base = OTHER; note = Cytosine phosphorothioate
  modified_base 63: mod_base = OTHER; note = Adenine phosphorothioate
  modified_base 64: mod_base = OTHER; note = Thymine phosphorothioate
  modified_base 65: mod_base = OTHER; note = Guanosine phosphorothioate
  modified_base 66: mod_base = OTHER; note = Thymine phosphorothioate

SEQ ID NO: 741 - DNA, 72 bp, synthetic construct; identical to SEQ ID NO: 102
  source 1..72: mol_type = other DNA
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Thymine phosphorothioate
  modified_base 62: mod_base = OTHER; note = Adenine phosphorothioate
  modified_base 63: mod_base = OTHER; note = Guanosine phosphorothioate
  modified_base 64: mod_base = OTHER; note = Thymine phosphorothioate
  modified_base 65: mod_base = OTHER; note = Guanosine phosphorothioate
  modified_base 66: mod_base = OTHER; note = Thymine phosphorothioate

SEQ ID NO: 742 - DNA, 72 bp, synthetic construct; identical to SEQ ID NO: 103
  source 1..72: mol_type = other DNA
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Thymine phosphorothioate
  modified_base 62: mod_base = OTHER; note = Cytosine phosphorothioate
  modified_base 63: mod_base = OTHER; note = Adenine phosphorothioate
  modified_base 64: mod_base = OTHER; note = Thymine phosphorothioate
  modified_base 65: mod_base = OTHER; note = Guanosine phosphorothioate
  modified_base 66: mod_base = OTHER; note = Thymine phosphorothioate

SEQ ID NO: 743 - DNA, 72 bp, synthetic construct; identical to SEQ ID NO: 104
  source 1..72: mol_type = other DNA
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Thymine phosphorothioate
  modified_base 62: mod_base = OTHER; note = Adenine phosphorothioate
  modified_base 63: mod_base = OTHER; note = Guanosine phosphorothioate
  modified_base 64: mod_base = OTHER; note = Thymine phosphorothioate
  modified_base 65: mod_base = OTHER; note = Adenine phosphorothioate
  modified_base 66: mod_base = OTHER; note = Thymine phosphorothioate

SEQ ID NO: 744 - DNA, 72 bp, synthetic construct; identical to SEQ ID NO: 105
  source 1..72: mol_type = other DNA
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Thymine phosphorothioate
  modified_base 62: mod_base = OTHER; note = Cytosine phosphorothioate
  modified_base 63: mod_base = OTHER; note = Guanosine phosphorothioate
  modified_base 64: mod_base = OTHER; note = Thymine phosphorothioate
  modified_base 65: mod_base = OTHER; note = Guanosine phosphorothioate
  modified_base 66: mod_base = OTHER; note = Thymine phosphorothioate

SEQ ID NO: 745 - DNA, 72 bp, synthetic construct; identical to SEQ ID NO: 106
  source 1..72: mol_type = other DNA
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Thymine phosphorothioate
  modified_base 62: mod_base = OTHER; note = Cytosine phosphorothioate
  modified_base 63: mod_base = OTHER; note = Guanosine phosphorothioate
  modified_base 64: mod_base = OTHER; note = Thymine phosphorothioate
  modified_base 65: mod_base = OTHER; note = Adenine phosphorothioate
  modified_base 66: mod_base = OTHER; note = Thymine phosphorothioate

SEQ ID NO: 746 - DNA, 66 bp, synthetic construct; identical to SEQ ID NO: 107
  source 1..66: mol_type = other DNA
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Adenine phosphorothioate

SEQ ID NO: 747 - DNA, 66 bp, synthetic construct; identical to SEQ ID NO: 108
  source 1..66: mol_type = other DNA
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Cytosine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Adenine phosphorothioate

SEQ ID NO: 748 - DNA, 66 bp, synthetic construct; identical to SEQ ID NO: 109
  source 1..66: mol_type = other DNA
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Cytosine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Cytosine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Adenine phosphorothioate

SEQ ID NO: 749 - DNA, 66 bp, synthetic construct; identical to SEQ ID NO: 110
  source 1..66: mol_type = other DNA
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Adenine phosphorothioate

SEQ ID NO: 750 - DNA, 66 bp, synthetic construct; identical to SEQ ID NO: 111
  source 1..66: mol_type = other DNA
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Cytosine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Adenine phosphorothioate

SEQ ID NO: 751 - DNA, 66 bp, synthetic construct; identical to SEQ ID NO: 112
  source 1..66: mol_type = other DNA
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Cytosine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Cytosine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Adenine phosphorothioate

SEQ ID NO: 752 - DNA, 66 bp, synthetic construct; identical to SEQ ID NO: 113
  source 1..66: mol_type = other DNA
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Cytosine phosphorothioate

SEQ ID NO: 753 - DNA, 66 bp, synthetic construct; identical to SEQ ID NO: 114
  source 1..66: mol_type = other DNA
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Cytosine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Cytosine phosphorothioate

SEQ ID NO: 754 - DNA, 66 bp, synthetic construct; identical to SEQ ID NO: 115
  source 1..66: mol_type = other DNA
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Cytosine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Cytosine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Cytosine phosphorothioate

SEQ ID NO: 755 - DNA, 66 bp, synthetic construct; identical to SEQ ID NO: 116
  source 1..66: mol_type = other DNA
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Guanosine phosphorothioate
  modified_base 60: mod_base = OTHER; note = Guanosine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Cytosine phosphorothioate

SEQ ID NO: 756 - DNA, 66 bp, synthetic construct; identical to SEQ ID NO: 117
  source 1..66: mol_type = other DNA
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Cytosine phosphorothioate
  modified_base 59: mod_base = OTHER; note = Guanosine phosphorothioate
  modified_base 60: mod_base = OTHER; note = Guanosine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Cytosine phosphorothioate

SEQ ID NO: 757 - DNA, 66 bp, synthetic construct; identical to SEQ ID NO: 118
  source 1..66: mol_type = other DNA
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Cytosine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Cytosine phosphorothioate
  modified_base 59: mod_base = OTHER; note = Guanosine phosphorothioate
  modified_base 60: mod_base = OTHER; note = Guanosine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Cytosine phosphorothioate

SEQ ID NO: 758 - DNA, 70 bp, synthetic construct; identical to SEQ ID NO: 119
  source 1..70: mol_type = other DNA
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Guanosine phosphorothioate
  modified_base 62: mod_base = OTHER; note = Thymine phosphorothioate
  modified_base 63: mod_base = OTHER; note = Guanosine phosphorothioate
  modified_base 64: mod_base = OTHER; note = Adenine phosphorothioate
  modified_base 65: mod_base = OTHER; note = Thymine phosphorothioate

SEQ ID NO: 759 - DNA, 70 bp, synthetic construct; identical to SEQ ID NO: 120
  source 1..70: mol_type = other DNA
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Guanosine phosphorothioate
  modified_base 64: mod_base = OTHER; note = Thymine phosphorothioate
  modified_base 65: mod_base = OTHER; note = Adenine phosphorothioate

SEQ ID NO: 760 - DNA, 70 bp, synthetic construct; identical to SEQ ID NO: 121
  source 1..70: mol_type = other DNA
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Cytosine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Guanosine phosphorothioate
  modified_base 64: mod_base = OTHER; note = Thymine phosphorothioate
  modified_base 65: mod_base = OTHER; note = Adenine phosphorothioate

SEQ ID NO: 761 - DNA, 70 bp, synthetic construct; identical to SEQ ID NO: 122
  source 1..70: mol_type = other DNA
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Guanosine phosphorothioate
  modified_base 62: mod_base = OTHER; note = Thymine phosphorothioate
  modified_base 63: mod_base = OTHER; note = Guanosine phosphorothioate
  modified_base 64: mod_base = OTHER; note = Thymine phosphorothioate
  modified_base 65: mod_base = OTHER; note = Adenine phosphorothioate

SEQ ID NO: 762 - DNA, 70 bp, synthetic construct; identical to SEQ ID NO: 123
  source 1..70: mol_type = other DNA
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Guanosine phosphorothioate
  modified_base 64: mod_base = OTHER; note = Thymine phosphorothioate
  modified_base 65: mod_base = OTHER; note = Adenine phosphorothioate

SEQ ID NO: 763 - DNA, 70 bp, synthetic construct; identical to SEQ ID NO: 124
  source 1..70: mol_type = other DNA
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Cytosine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Guanosine phosphorothioate
  modified_base 64: mod_base = OTHER; note = Thymine phosphorothioate
  modified_base 65: mod_base = OTHER; note = Adenine phosphorothioate

SEQ ID NO: 764 - DNA, 70 bp, synthetic construct; identical to SEQ ID NO: 125
  source 1..70: mol_type = other DNA
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Guanosine phosphorothioate
  modified_base 62: mod_base = OTHER; note = Thymine phosphorothioate
  modified_base 63: mod_base = OTHER; note = Adenine phosphorothioate
  modified_base 64: mod_base = OTHER; note = Thymine phosphorothioate
  modified_base 65: mod_base = OTHER; note = Adenine phosphorothioate

SEQ ID NO: 765 - DNA, 70 bp, synthetic construct; identical to SEQ ID NO: 126
  source 1..70: mol_type = other DNA
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Guanosine phosphorothioate
  modified_base 62: mod_base = OTHER; note = Thymine phosphorothioate
  modified_base 63: mod_base = OTHER; note = Guanosine phosphorothioate
  modified_base 64: mod_base = OTHER; note = Thymine phosphorothioate
  modified_base 65: mod_base = OTHER; note = Adenine phosphorothioate

SEQ ID NO: 766 - DNA, 70 bp, synthetic construct; identical to SEQ ID NO: 127
  source 1..70: mol_type = other DNA
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Cytosine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Guanosine phosphorothioate
  modified_base 62: mod_base = OTHER; note = Thymine phosphorothioate
  modified_base 63: mod_base = OTHER; note = Guanosine phosphorothioate
  modified_base 64: mod_base = OTHER; note = Thymine phosphorothioate
  modified_base 65: mod_base = OTHER; note = Adenine phosphorothioate

SEQ ID NO: 767 - DNA, 70 bp, synthetic construct; identical to SEQ ID NO: 128
  source 1..70: mol_type = other DNA
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Guanosine phosphorothioate
  modified_base 62: mod_base = OTHER; note = Thymine phosphorothioate
  modified_base 63: mod_base = OTHER; note = Adenine phosphorothioate
  modified_base 64: mod_base = OTHER; note = Thymine phosphorothioate
  modified_base 65: mod_base = OTHER; note = Adenine phosphorothioate

SEQ ID NO: 768 - DNA, 70 bp, synthetic construct; identical to SEQ ID NO: 129
  source 1..70: mol_type = other DNA
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Cytosine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Guanosine phosphorothioate
  modified_base 62: mod_base = OTHER; note = Thymine phosphorothioate
  modified_base 63: mod_base = OTHER; note = Adenine phosphorothioate
  modified_base 64: mod_base = OTHER; note = Thymine phosphorothioate
  modified_base 65: mod_base = OTHER; note = Adenine phosphorothioate

SEQ ID NO: 769 - DNA, 68 bp, synthetic construct; identical to SEQ ID NO: 130
  source 1..68: mol_type = other DNA
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Guanosine phosphorothioate
  modified_base 62: mod_base = OTHER; note = Adenine phosphorothioate
  modified_base 63: mod_base = OTHER; note = Thymine phosphorothioate
  modified_base 64: mod_base = OTHER; note = Adenine phosphorothioate

SEQ ID NO: 770 - DNA, 68 bp, synthetic construct; identical to SEQ ID NO: 131
  source 1..68: mol_type = other DNA
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Cytosine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Guanosine phosphorothioate
  modified_base 62: mod_base = OTHER; note = Thymine phosphorothioate
  modified_base 63: mod_base = OTHER; note = Adenine phosphorothioate
  modified_base 64: mod_base = OTHER; note = Thymine phosphorothioate

SEQ ID NO: 771 - DNA, 68 bp, synthetic construct; identical to SEQ ID NO: 132
  source 1..68: mol_type = other DNA
  modified_base 49: mod_base = OTHER; note = Thymine phosphorothioate
  modified_base 50: mod_base = OTHER; note = Adenine phosphorothioate
  modified_base 51: mod_base = OTHER; note = Cytosine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Cytosine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Guanosine phosphorothioate
  modified_base 62: mod_base = OTHER; note = Thymine phosphorothioate
  modified_base 63: mod_base = OTHER; note = Adenine phosphorothioate
  modified_base 64: mod_base = OTHER; note = Thymine phosphorothioate

SEQ ID NO: 772 - DNA, 68 bp, synthetic construct; identical to SEQ ID NO: 133
  source 1..68: mol_type = other DNA
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Guanosine phosphorothioate
  modified_base 62: mod_base = OTHER; note = Thymine phosphorothioate
  modified_base 63: mod_base = OTHER; note = Adenine phosphorothioate
  modified_base 64: mod_base = OTHER; note = Thymine phosphorothioate

SEQ ID NO: 773 - DNA, 68 bp, synthetic construct; identical to SEQ ID NO: 134
  source 1..68: mol_type = other DNA
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Cytosine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Guanosine phosphorothioate
  modified_base 62: mod_base = OTHER; note = Thymine phosphorothioate
  modified_base 63: mod_base = OTHER; note = Adenine phosphorothioate
  modified_base 64: mod_base = OTHER; note = Thymine phosphorothioate

SEQ ID NO: 774 - DNA, 68 bp, synthetic construct; identical to SEQ ID NO: 135
  source 1..68: mol_type = other DNA
  modified_base 49: mod_base = OTHER; note = Thymine phosphorothioate
  modified_base 50: mod_base = OTHER; note = Adenine phosphorothioate
  modified_base 51: mod_base = OTHER; note = Cytosine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Cytosine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Guanosine phosphorothioate
  modified_base 62: mod_base = OTHER; note = Thymine phosphorothioate
  modified_base 63: mod_base = OTHER; note = Adenine phosphorothioate
  modified_base 64: mod_base = OTHER; note = Thymine phosphorothioate

SEQ ID NO: 775 - DNA, 68 bp, synthetic construct; identical to SEQ ID NO: 136
  source 1..68: mol_type = other DNA
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Adenine phosphorothioate
  modified_base 64: mod_base = OTHER; note = Thymine phosphorothioate

SEQ ID NO: 776 - DNA, 68 bp, synthetic construct; identical to SEQ ID NO: 137
  source 1..68: mol_type = other DNA
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Cytosine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Guanosine phosphorothioate
  modified_base 62: mod_base = OTHER; note = Thymine phosphorothioate
  modified_base 63: mod_base = OTHER; note = Adenine phosphorothioate
  modified_base 64: mod_base = OTHER; note = Thymine phosphorothioate

SEQ ID NO: 777 - DNA, 68 bp, synthetic construct; identical to SEQ ID NO: 138
  source 1..68: mol_type = other DNA
  modified_base 49: mod_base = OTHER; note = Thymine phosphorothioate
  modified_base 50: mod_base = OTHER; note = Adenine phosphorothioate
  modified_base 51: mod_base = OTHER; note = Cytosine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Cytosine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Guanosine phosphorothioate
  modified_base 62: mod_base = OTHER; note = Thymine phosphorothioate
  modified_base 63: mod_base = OTHER; note = Adenine phosphorothioate
  modified_base 64: mod_base = OTHER; note = Thymine phosphorothioate

SEQ ID NO: 778 - DNA, 68 bp, synthetic construct; identical to SEQ ID NO: 139
  source 1..68: mol_type = other DNA
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Cytosine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Adenine phosphorothioate
  modified_base 64: mod_base = OTHER; note = Thymine phosphorothioate

SEQ ID NO: 779 - DNA, 68 bp, synthetic construct; identical to SEQ ID NO: 140
  source 1..68: mol_type = other DNA
  modified_base 49: mod_base = OTHER; note = Thymine phosphorothioate
  modified_base 50: mod_base = OTHER; note = Adenine phosphorothioate
  modified_base 51: mod_base = OTHER; note = Cytosine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Cytosine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Adenine phosphorothioate
  modified_base 64: mod_base = OTHER; note = Thymine phosphorothioate

SEQ ID NO: 780 - DNA, 66 bp, synthetic construct; identical to SEQ ID NO: 141
  source 1..66: mol_type = other DNA
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Guanosine phosphorothioate
  modified_base 58: mod_base = OTHER; note = Thymine phosphorothioate
  modified_base 59: mod_base = OTHER; note = Guanosine phosphorothioate
  modified_base 60: mod_base = OTHER; note = Adenine phosphorothioate
  modified_base 61: mod_base = OTHER; note = Thymine phosphorothioate
  modified_base 62: mod_base = OTHER; note = Adenine phosphorothioate
  modified_base 63: mod_base = OTHER; note = Thymine phosphorothioate

SEQ ID NO: 781 - DNA, 66 bp, synthetic construct; identical to SEQ ID NO: 142
  source 1..66: mol_type = other DNA
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Cytosine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Adenine phosphorothioate

SEQ ID NO: 782 - DNA, 66 bp, synthetic construct; identical to SEQ ID NO: 143
  source 1..66: mol_type = other DNA
  modified_base 48: mod_base = OTHER; note = Adenine phosphorothioate
  modified_base 49: mod_base = OTHER; note = Cytosine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Cytosine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Adenine phosphorothioate

SEQ ID NO: 783 - DNA, 66 bp, synthetic construct; identical to SEQ ID NO: 144
  source 1..66: mol_type = other DNA
  modified_base 48: mod_base = OTHER; note = Thymine phosphorothioate
  modified_base 49: mod_base = OTHER; note = Adenine phosphorothioate
  modified_base 50: mod_base = OTHER; note = Cytosine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Guanosine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Cytosine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Adenine phosphorothioate

SEQ ID NO: 784 - DNA, 66 bp, synthetic construct; identical to SEQ ID NO: 145
  source 1..66: mol_type = other DNA
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Guanosine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Cytosine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Adenine phosphorothioate

SEQ ID NO: 785 - DNA, 66 bp, synthetic construct; identical to SEQ ID NO: 146
  source 1..66: mol_type = other DNA
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Guanosine phosphorothioate
  modified_base 58: mod_base = OTHER; note = Thymine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Adenine phosphorothioate

SEQ ID NO: 786 - DNA, 66 bp, synthetic construct; identical to SEQ ID NO: 147
  source 1..66: mol_type = other DNA
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Cytosine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Adenine phosphorothioate

SEQ ID NO: 787 - DNA, 66 bp, synthetic construct; identical to SEQ ID NO: 148
  source 1..66: mol_type = other DNA
  modified_base 48: mod_base = OTHER; note = Adenine phosphorothioate
  modified_base 49: mod_base = OTHER; note = Cytosine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Cytosine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Adenine phosphorothioate

SEQ ID NO: 788 - DNA, 66 bp, synthetic construct; identical to SEQ ID NO: 149
  source 1..66: mol_type = other DNA
  modified_base 48: mod_base = OTHER; note = Thymine phosphorothioate
  modified_base 49: mod_base = OTHER; note = Adenine phosphorothioate
  modified_base 50: mod_base = OTHER; note = Cytosine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Guanosine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Cytosine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Adenine phosphorothioate

SEQ ID NO: 789 - DNA, 66 bp, synthetic construct; identical to SEQ ID NO: 150
  source 1..66: mol_type = other DNA
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Guanosine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Cytosine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Adenine phosphorothioate

SEQ ID NO: 790 - DNA, 66 bp, synthetic construct; identical to SEQ ID NO: 151
  source 1..66: mol_type = other DNA
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Guanosine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Adenine phosphorothioate

SEQ ID NO: 791 - DNA, 66 bp, synthetic construct; identical to SEQ ID NO: 152
  source 1..66: mol_type = other DNA
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Cytosine phosphorothioate
  modified_base 57: mod_base = OTHER; note = Guanosine phosphorothioate
  modified_base 58: mod_base = OTHER; note = Thymine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Adenine phosphorothioate

SEQ ID NO: 792 - DNA, 66 bp, synthetic construct; identical to SEQ ID NO: 153
  source 1..66: mol_type = other DNA
  modified_base 48: mod_base = OTHER; note = Adenine phosphorothioate
  modified_base 49: mod_base = OTHER; note = Cytosine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Cytosine phosphorothioate
  modified_base 57: mod_base = OTHER; note = Guanosine phosphorothioate
  modified_base 58: mod_base = OTHER; note = Thymine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Adenine phosphorothioate

SEQ ID NO: 793 - DNA, 66 bp, synthetic construct; identical to SEQ ID NO: 154
  source 1..66: mol_type = other DNA
  modified_base 48: mod_base = OTHER; note = Thymine phosphorothioate
  modified_base 49: mod_base = OTHER; note = Adenine phosphorothioate
  modified_base 50: mod_base = OTHER; note = Cytosine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Guanosine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Cytosine phosphorothioate
  modified_base 57: mod_base = OTHER; note = Guanosine phosphorothioate
  modified_base 58: mod_base = OTHER; note = Thymine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Adenine phosphorothioate

SEQ ID NO: 794 - DNA, 66 bp, synthetic construct; identical to SEQ ID NO: 155
  source 1..66: mol_type = other DNA
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Guanosine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Cytosine phosphorothioate
  modified_base 57: mod_base = OTHER; note = Guanosine phosphorothioate
  modified_base 58: mod_base = OTHER; note = Thymine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Adenine phosphorothioate

SEQ ID NO: 795 - DNA, 66 bp, synthetic construct; identical to SEQ ID NO: 156
  source 1..66: mol_type = other DNA
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Cytosine phosphorothioate
  modified_base 57: mod_base = OTHER; note = Guanosine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Adenine phosphorothioate

SEQ ID NO: 796 - DNA, 66 bp, synthetic construct; identical to SEQ ID NO: 157
  source 1..66: mol_type = other DNA
  modified_base 48: mod_base = OTHER; note = Adenine phosphorothioate
  modified_base 49: mod_base = OTHER; note = Cytosine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Cytosine phosphorothioate
  modified_base 57: mod_base = OTHER; note = Guanosine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Adenine phosphorothioate

SEQ ID NO: 797 - DNA, 66 bp, synthetic construct; identical to SEQ ID NO: 158
  source 1..66: mol_type = other DNA
  modified_base 48: mod_base = OTHER; note = Thymine phosphorothioate
  modified_base 49: mod_base = OTHER; note = Adenine phosphorothioate
  modified_base 50: mod_base = OTHER; note = Cytosine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Guanosine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Cytosine phosphorothioate
  modified_base 57: mod_base = OTHER; note = Guanosine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Adenine phosphorothioate

SEQ ID NO: 798 - DNA, 66 bp, synthetic construct; identical to SEQ ID NO: 159
  source 1..66: mol_type = other DNA
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Guanosine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Cytosine phosphorothioate
  modified_base 57: mod_base = OTHER; note = Guanosine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Adenine phosphorothioate

SEQ ID NO: 799 - DNA, 64 bp, synthetic construct; identical to SEQ ID NO: 160
  source 1..64: mol_type = other DNA
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Cytosine phosphorothioate
  modified_base 54: mod_base = OTHER; note = Adenine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Guanosine phosphorothioate
  modified_base 62: mod_base = OTHER; note = Thymine phosphorothioate

SEQ ID NO: 800 - DNA, 64 bp, synthetic construct; identical to SEQ ID NO: 161
  source 1..64: mol_type = other DNA
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Cytosine phosphorothioate
  modified_base 54: mod_base = OTHER; note = Adenine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Guanosine phosphorothioate
  modified_base 62: mod_base = OTHER; note = Thymine phosphorothioate

SEQ ID NO: 801 - DNA, 64 bp, synthetic construct; identical to SEQ ID NO: 162
  source 1..64: mol_type = other DNA
  modified_base 47: mod_base = OTHER; note = Cytosine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Guanosine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Cytosine phosphorothioate
  modified_base 54: mod_base = OTHER; note = Adenine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Guanosine phosphorothioate
  modified_base 62: mod_base = OTHER; note = Thymine phosphorothioate

SEQ ID NO: 802 - DNA, 64 bp, synthetic construct; identical to SEQ ID NO: 163
  source 1..64: mol_type = other DNA
  modified_base 47: mod_base = OTHER; note = Thymine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Guanosine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Cytosine phosphorothioate
  modified_base 54: mod_base = OTHER; note = Adenine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Guanosine phosphorothioate
  modified_base 62: mod_base = OTHER; note = Thymine phosphorothioate

SEQ ID NO: 803 - DNA, 64 bp, synthetic construct; identical to SEQ ID NO: 164
  source 1..64: mol_type = other DNA
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Guanosine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Cytosine phosphorothioate
  modified_base 62: mod_base = OTHER; note = Adenine phosphorothioate

SEQ ID NO: 804 - DNA, 64 bp, synthetic construct; identical to SEQ ID NO: 165
  source 1..64: mol_type = other DNA
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Cytosine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Guanosine phosphorothioate
  modified_base 61: mod_base = OTHER; note = Thymine phosphorothioate
  modified_base 62: mod_base = OTHER; note = Adenine phosphorothioate

SEQ ID NO: 805 - DNA, 64 bp, synthetic construct; identical to SEQ ID NO: 166
  source 1..64: mol_type = other DNA
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Cytosine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Guanosine phosphorothioate
  modified_base 61: mod_base = OTHER; note = Thymine phosphorothioate
  modified_base 62: mod_base = OTHER; note = Adenine phosphorothioate

SEQ ID NO: 806 - DNA, 64 bp, synthetic construct; identical to SEQ ID NO: 167
  source 1..64: mol_type = other DNA
  modified_base 47: mod_base = OTHER; note = Cytosine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Guanosine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Cytosine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Guanosine phosphorothioate
  modified_base 61: mod_base = OTHER; note = Thymine phosphorothioate
  modified_base 62: mod_base = OTHER; note = Adenine phosphorothioate

SEQ ID NO: 807 - DNA, 64 bp, synthetic construct; identical to SEQ ID NO: 168
  source 1..64: mol_type = other DNA
  modified_base 47: mod_base = OTHER; note = Thymine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Guanosine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Cytosine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Guanosine phosphorothioate
  modified_base 61: mod_base = OTHER; note = Thymine phosphorothioate
  modified_base 62: mod_base = OTHER; note = Adenine phosphorothioate

SEQ ID NO: 808 - DNA, 66 bp, synthetic construct; identical to SEQ ID NO: 169
  source 1..66: mol_type = other DNA
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Cytosine phosphorothioate
  modified_base 55: mod_base = OTHER; note = Adenine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Thymine phosphorothioate
  modified_base 62: mod_base = OTHER; note = Guanosine phosphorothioate
  modified_base 63: mod_base = OTHER; note = Adenine phosphorothioate

SEQ ID NO: 809 - DNA, 66 bp, synthetic construct; identical to SEQ ID NO: 170
  source 1..66: mol_type = other DNA
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Cytosine phosphorothioate
  modified_base 55: mod_base = OTHER; note = Adenine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Thymine phosphorothioate
  modified_base 62: mod_base = OTHER; note = Guanosine phosphorothioate
  modified_base 63: mod_base = OTHER; note = Adenine phosphorothioate

SEQ ID NO: 810 - DNA, 66 bp, synthetic construct; identical to SEQ ID NO: 171
  source 1..66: mol_type = other DNA
  modified_base 48: mod_base = OTHER; note = Cytosine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Guanosine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Cytosine phosphorothioate
  modified_base 55: mod_base = OTHER; note = Adenine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Thymine phosphorothioate
  modified_base 62: mod_base = OTHER; note = Guanosine phosphorothioate
  modified_base 63: mod_base = OTHER; note = Adenine phosphorothioate

SEQ ID NO: 811 - DNA, 66 bp, synthetic construct; identical to SEQ ID NO: 172
  source 1..66: mol_type = other DNA
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Guanosine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Cytosine phosphorothioate
  modified_base 55: mod_base = OTHER; note = Adenine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Thymine phosphorothioate
  modified_base 62: mod_base = OTHER; note = Guanosine phosphorothioate
  modified_base 63: mod_base = OTHER; note = Adenine phosphorothioate

SEQ ID NO: 812 - DNA, 62 bp, synthetic construct; identical to SEQ ID NO: 173
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Guanosine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Thymine phosphorothioate

SEQ ID NO: 813 - DNA, 62 bp, synthetic construct; identical to SEQ ID NO: 174
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Guanosine phosphorothioate
  modified_base 59: mod_base = OTHER; note = Thymine phosphorothioate
  modified_base 60: mod_base = OTHER; note = Guanosine phosphorothioate
  modified_base 61: mod_base = OTHER; note = Thymine phosphorothioate

SEQ ID NO: 814 - DNA, 62 bp, synthetic construct; identical to SEQ ID NO: 175
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Cytosine phosphorothioate
  modified_base 58: mod_base = OTHER; note = Guanosine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Thymine phosphorothioate

SEQ ID NO: 815 - DNA, 62 bp, synthetic construct; identical to SEQ ID NO: 176
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Cytosine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Cytosine phosphorothioate
  modified_base 58: mod_base = OTHER; note = Guanosine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Thymine phosphorothioate

SEQ ID NO: 816 - DNA, 62 bp, synthetic construct; identical to SEQ ID NO: 177
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Cytosine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Guanosine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Cytosine phosphorothioate
  modified_base 58: mod_base = OTHER; note = Guanosine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Thymine phosphorothioate

SEQ ID NO: 817 - DNA, 62 bp, synthetic construct; identical to SEQ ID NO: 178
  source 1..62: mol_type = other DNA
  modified_base 46: mod_base = OTHER; note = Adenine phosphorothioate
  modified_base 47: mod_base = OTHER; note = Cytosine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Guanosine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Cytosine phosphorothioate
  modified_base 58: mod_base = OTHER; note = Guanosine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Thymine phosphorothioate

SEQ ID NO: 818 - DNA, 62 bp, synthetic construct; identical to SEQ ID NO: 179
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Guanosine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Cytosine phosphorothioate

SEQ ID NO: 819 - DNA, 62 bp, synthetic construct; identical to SEQ ID NO: 180
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Cytosine phosphorothioate
  modified_base 58: mod_base = OTHER; note = Guanosine phosphorothioate
  modified_base 59: mod_base = OTHER; note = Thymine phosphorothioate
  modified_base 60: mod_base = OTHER; note = Guanosine phosphorothioate
  modified_base 61: mod_base = OTHER; note = Thymine phosphorothioate

SEQ ID NO: 820 - DNA, 62 bp, synthetic construct; identical to SEQ ID NO: 181
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Cytosine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Cytosine phosphorothioate
  modified_base 58: mod_base = OTHER; note = Guanosine phosphorothioate
  modified_base 59: mod_base = OTHER; note = Thymine phosphorothioate
  modified_base 60: mod_base = OTHER; note = Guanosine phosphorothioate
  modified_base 61: mod_base = OTHER; note = Thymine phosphorothioate

SEQ ID NO: 821 - DNA, 62 bp, synthetic construct; identical to SEQ ID NO: 182
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Cytosine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Guanosine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Cytosine phosphorothioate
  modified_base 58: mod_base = OTHER; note = Guanosine phosphorothioate
  modified_base 59: mod_base = OTHER; note = Thymine phosphorothioate
  modified_base 60: mod_base = OTHER; note = Guanosine phosphorothioate
  modified_base 61: mod_base = OTHER; note = Thymine phosphorothioate

SEQ ID NO: 822 - DNA, 62 bp, synthetic construct; identical to SEQ ID NO: 183
  source 1..62: mol_type = other DNA
  modified_base 46: mod_base = OTHER; note = Adenine phosphorothioate
  modified_base 47: mod_base = OTHER; note = Cytosine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Guanosine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Cytosine phosphorothioate
  modified_base 58: mod_base = OTHER; note = Guanosine phosphorothioate
  modified_base 59: mod_base = OTHER; note = Thymine phosphorothioate
  modified_base 60: mod_base = OTHER; note = Guanosine phosphorothioate
  modified_base 61: mod_base = OTHER; note = Thymine phosphorothioate

SEQ ID NO: 823 - DNA, 62 bp, synthetic construct; identical to SEQ ID NO: 184
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Cytosine phosphorothioate
  modified_base 58: mod_base = OTHER; note = Guanosine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Cytosine phosphorothioate

SEQ ID NO: 824 - DNA, 62 bp, synthetic construct; identical to SEQ ID NO: 185
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Cytosine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Cytosine phosphorothioate
  modified_base 58: mod_base = OTHER; note = Guanosine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Cytosine phosphorothioate

SEQ ID NO: 825 - DNA, 62 bp, synthetic construct; identical to SEQ ID NO: 186
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Cytosine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Guanosine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Cytosine phosphorothioate
  modified_base 58: mod_base = OTHER; note = Guanosine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Cytosine phosphorothioate

SEQ ID NO: 826 - DNA, 62 bp, synthetic construct; identical to SEQ ID NO: 187
  source 1..62: mol_type = other DNA
  modified_base 46: mod_base = OTHER; note = Adenine phosphorothioate
  modified_base 47: mod_base = OTHER; note = Cytosine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Guanosine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Cytosine phosphorothioate
  modified_base 58: mod_base = OTHER; note = Guanosine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Cytosine phosphorothioate

SEQ ID NO: 827 - DNA, 62 bp, synthetic construct; identical to SEQ ID NO: 188
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Guanosine phosphorothioate
  modified_base 59: mod_base = OTHER; note = Adenine phosphorothioate
  modified_base 60: mod_base = OTHER; note = Cytosine phosphorothioate
  modified_base 61: mod_base = OTHER; note = Guanosine phosphorothioate

SEQ ID NO: 828 - DNA, 62 bp, synthetic construct; identical to SEQ ID NO: 189
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Cytosine phosphorothioate
  modified_base 58: mod_base = OTHER; note = Guanosine phosphorothioate
  modified_base 59: mod_base = OTHER; note = Adenine phosphorothioate
  modified_base 60: mod_base = OTHER; note = Cytosine phosphorothioate
  modified_base 61: mod_base = OTHER; note = Guanosine phosphorothioate

SEQ ID NO: 829 - DNA, 62 bp, synthetic construct; identical to SEQ ID NO: 190
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Cytosine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Cytosine phosphorothioate
  modified_base 58: mod_base = OTHER; note = Guanosine phosphorothioate
  modified_base 59: mod_base = OTHER; note = Adenine phosphorothioate
  modified_base 60: mod_base = OTHER; note = Cytosine phosphorothioate
  modified_base 61: mod_base = OTHER; note = Guanosine phosphorothioate

SEQ ID NO: 830 - DNA, 62 bp, synthetic construct; identical to SEQ ID NO: 191
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Cytosine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Guanosine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Cytosine phosphorothioate
  modified_base 58: mod_base = OTHER; note = Guanosine phosphorothioate
  modified_base 59: mod_base = OTHER; note = Adenine phosphorothioate
  modified_base 60: mod_base = OTHER; note = Cytosine phosphorothioate
  modified_base 61: mod_base = OTHER; note = Guanosine phosphorothioate

SEQ ID NO: 831 - DNA, 62 bp, synthetic construct; identical to SEQ ID NO: 192
  source 1..62: mol_type = other DNA
  modified_base 46: mod_base = OTHER; note = Adenine phosphorothioate
  modified_base 47: mod_base = OTHER; note = Cytosine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Guanosine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Cytosine phosphorothioate
  modified_base 58: mod_base = OTHER; note = Guanosine phosphorothioate
  modified_base 59: mod_base = OTHER; note = Adenine phosphorothioate
  modified_base 60: mod_base = OTHER; note = Cytosine phosphorothioate
  modified_base 61: mod_base = OTHER; note = Guanosine phosphorothioate

SEQ ID NO: 832 - DNA, 62 bp, synthetic construct; identical to SEQ ID NO: 193
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Cytosine phosphorothioate
  modified_base 57: mod_base = OTHER; note = Guanosine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Adenine phosphorothioate

SEQ ID NO: 833 - DNA, 62 bp, synthetic construct; identical to SEQ ID NO: 194
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Cytosine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Cytosine phosphorothioate
  modified_base 57: mod_base = OTHER; note = Guanosine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Adenine phosphorothioate

SEQ ID NO: 834 - DNA, 62 bp, synthetic construct; identical to SEQ ID NO: 195
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Cytosine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Guanosine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Cytosine phosphorothioate
  modified_base 57: mod_base = OTHER; note = Guanosine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Adenine phosphorothioate

SEQ ID NO: 835 - DNA, 62 bp, synthetic construct; identical to SEQ ID NO: 196
  source 1..62: mol_type = other DNA
  modified_base 46: mod_base = OTHER; note = Cytosine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Guanosine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Cytosine phosphorothioate
  modified_base 57: mod_base = OTHER; note = Guanosine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Adenine phosphorothioate

SEQ ID NO: 836 - DNA, 62 bp, synthetic construct; identical to SEQ ID NO: 197
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Cytosine phosphorothioate
  modified_base 57: mod_base = OTHER; note = Guanosine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Adenine phosphorothioate

SEQ ID NO: 837 - DNA, 62 bp, synthetic construct; identical to SEQ ID NO: 198
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Cytosine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Cytosine phosphorothioate
  modified_base 57: mod_base = OTHER; note = Guanosine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Adenine phosphorothioate

SEQ ID NO: 838 - DNA, 62 bp, synthetic construct; identical to SEQ ID NO: 199
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Cytosine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Guanosine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Cytosine phosphorothioate
  modified_base 57: mod_base = OTHER; note = Guanosine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Adenine phosphorothioate

SEQ ID NO: 839 - DNA, 62 bp, synthetic construct; identical to SEQ ID NO: 200
  source 1..62: mol_type = other DNA
  modified_base 46: mod_base = OTHER; note = Cytosine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Guanosine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Cytosine phosphorothioate
  modified_base 57: mod_base = OTHER; note = Guanosine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Adenine phosphorothioate

SEQ ID NO: 840 - DNA, 62 bp, synthetic construct; identical to SEQ ID NO: 201
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Cytosine phosphorothioate
  modified_base 57: mod_base = OTHER; note = Guanosine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Cytosine phosphorothioate

SEQ ID NO: 841 - DNA, 62 bp, synthetic construct; identical to SEQ ID NO: 202
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Cytosine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Cytosine phosphorothioate
  modified_base 57: mod_base = OTHER; note = Guanosine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Cytosine phosphorothioate

SEQ ID NO: 842 - DNA, 62 bp, synthetic construct; identical to SEQ ID NO: 203
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Cytosine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Guanosine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Cytosine phosphorothioate
  modified_base 57: mod_base = OTHER; note = Guanosine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Cytosine phosphorothioate

SEQ ID NO: 843 - DNA, 62 bp, synthetic construct; identical to SEQ ID NO: 204
  source 1..62: mol_type = other DNA
  modified_base 46: mod_base = OTHER; note = Cytosine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Guanosine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Cytosine phosphorothioate
  modified_base 57: mod_base = OTHER; note = Guanosine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Cytosine phosphorothioate

SEQ ID NO: 844 - DNA, 62 bp, synthetic construct; identical to SEQ ID NO: 205
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Cytosine phosphorothioate
  modified_base 57: mod_base = OTHER; note = Guanosine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Guanosine phosphorothioate

SEQ ID NO: 845 - DNA, 62 bp, synthetic construct; identical to SEQ ID NO: 206
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Cytosine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Cytosine phosphorothioate
  modified_base 57: mod_base = OTHER; note = Guanosine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Guanosine phosphorothioate

SEQ ID NO: 846 - DNA, 62 bp, synthetic construct; identical to SEQ ID NO: 207
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Cytosine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Guanosine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Cytosine phosphorothioate
  modified_base 57: mod_base = OTHER; note = Guanosine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Guanosine phosphorothioate

SEQ ID NO: 847 - DNA, 62 bp, synthetic construct; identical to SEQ ID NO: 208
  source 1..62: mol_type = other DNA
  modified_base 46: mod_base = OTHER; note = Cytosine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Guanosine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Cytosine phosphorothioate
  modified_base 57: mod_base = OTHER; note = Guanosine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Guanosine phosphorothioate

SEQ ID NO: 848 - DNA, 62 bp, synthetic construct; identical to SEQ ID NO: 209
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Adenine phosphorothioate
  modified_base 56: mod_base = OTHER; note = Guanosine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Thymine phosphorothioate

SEQ ID NO: 849 - DNA, 62 bp, synthetic construct; identical to SEQ ID NO: 210
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Cytosine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Cytosine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Thymine phosphorothioate

SEQ ID NO: 850 - DNA, 62 bp, synthetic construct; identical to SEQ ID NO: 211
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Cytosine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Guanosine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Cytosine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Thymine phosphorothioate

SEQ ID NO: 851 - DNA, 62 bp, synthetic construct; identical to SEQ ID NO: 212
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Guanosine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Cytosine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Thymine phosphorothioate

SEQ ID NO: 852 - DNA, 62 bp, synthetic construct; identical to SEQ ID NO: 213
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Adenine phosphorothioate
  modified_base 56: mod_base = OTHER; note = Guanosine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Adenine phosphorothioate

SEQ ID NO: 853 - DNA, 62 bp, synthetic construct; identical to SEQ ID NO: 214
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Cytosine phosphorothioate
  modified_base 56: mod_base = OTHER; note = Guanosine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Thymine phosphorothioate

SEQ ID NO: 854 - DNA, 62 bp, synthetic construct; identical to SEQ ID NO: 215
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Cytosine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Guanosine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Cytosine phosphorothioate
  modified_base 56: mod_base = OTHER; note = Guanosine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Thymine phosphorothioate

SEQ ID NO: 855 - DNA, 62 bp, synthetic construct; identical to SEQ ID NO: 216
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Guanosine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Cytosine phosphorothioate
  modified_base 56: mod_base = OTHER; note = Guanosine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Thymine phosphorothioate

SEQ ID NO: 856 - DNA, 62 bp, synthetic construct; identical to SEQ ID NO: 217
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Adenine phosphorothioate
  modified_base 56: mod_base = OTHER; note = Guanosine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Cytosine phosphorothioate

SEQ ID NO: 857 - DNA, 62 bp, synthetic construct; identical to SEQ ID NO: 218
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Cytosine phosphorothioate
  modified_base 56: mod_base = OTHER; note = Guanosine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Adenine phosphorothioate

SEQ ID NO: 858 - DNA, 62 bp, synthetic construct; identical to SEQ ID NO: 219
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Cytosine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Cytosine phosphorothioate
  modified_base 56: mod_base = OTHER; note = Guanosine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Adenine phosphorothioate

SEQ ID NO: 859 - DNA, 62 bp, synthetic construct; identical to SEQ ID NO: 220
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Cytosine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Guanosine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Cytosine phosphorothioate
  modified_base 56: mod_base = OTHER; note = Guanosine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Adenine phosphorothioate

SEQ ID NO: 860 - DNA, 62 bp, synthetic construct; identical to SEQ ID NO: 221
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Guanosine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Cytosine phosphorothioate
  modified_base 56: mod_base = OTHER; note = Guanosine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Adenine phosphorothioate

SEQ ID NO: 861 - DNA, 62 bp, synthetic construct; identical to SEQ ID NO: 222
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Cytosine phosphorothioate
  modified_base 56: mod_base = OTHER; note = Guanosine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Cytosine phosphorothioate

SEQ ID NO: 862 - DNA, 62 bp, synthetic construct; identical to SEQ ID NO: 223
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Cytosine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Cytosine phosphorothioate
  modified_base 56: mod_base = OTHER; note = Guanosine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Cytosine phosphorothioate

SEQ ID NO: 863 - DNA, 62 bp, synthetic construct; identical to SEQ ID NO: 224
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Cytosine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Guanosine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Cytosine phosphorothioate
  modified_base 56: mod_base = OTHER; note = Guanosine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Cytosine phosphorothioate

SEQ ID NO: 864 - DNA, 62 bp, synthetic construct; identical to SEQ ID NO: 225
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Guanosine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Cytosine phosphorothioate
  modified_base 56: mod_base = OTHER; note = Guanosine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Cytosine phosphorothioate

SEQ ID NO: 865 - DNA, 62 bp, synthetic construct; identical to SEQ ID NO: 226
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Adenine phosphorothioate
  modified_base 56: mod_base = OTHER; note = Guanosine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Cytosine phosphorothioate
  modified_base 60: mod_base = OTHER; note = Adenine phosphorothioate
  modified_base 61: mod_base = OTHER; note = Cytosine phosphorothioate

SEQ ID NO: 866 - DNA, 62 bp, synthetic construct; identical to SEQ ID NO: 227
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Cytosine phosphorothioate
  modified_base 56: mod_base = OTHER; note = Guanosine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Cytosine phosphorothioate
  modified_base 60: mod_base = OTHER; note = Adenine phosphorothioate
  modified_base 61: mod_base = OTHER; note = Cytosine phosphorothioate

SEQ ID NO: 867 - DNA, 62 bp, synthetic construct; identical to SEQ ID NO: 228
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Cytosine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Cytosine phosphorothioate
  modified_base 56: mod_base = OTHER; note = Guanosine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Cytosine phosphorothioate
  modified_base 60: mod_base = OTHER; note = Adenine phosphorothioate
  modified_base 61: mod_base = OTHER; note = Cytosine phosphorothioate

SEQ ID NO: 868 - DNA, 62 bp, synthetic construct; identical to SEQ ID NO: 229
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Cytosine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Guanosine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Cytosine phosphorothioate
  modified_base 56: mod_base = OTHER; note = Guanosine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Cytosine phosphorothioate
  modified_base 60: mod_base = OTHER; note = Adenine phosphorothioate
  modified_base 61: mod_base = OTHER; note = Cytosine phosphorothioate

SEQ ID NO: 869 - DNA, 62 bp, synthetic construct; identical to SEQ ID NO: 230
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Guanosine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Cytosine phosphorothioate
  modified_base 56: mod_base = OTHER; note = Guanosine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Cytosine phosphorothioate
  modified_base 60: mod_base = OTHER; note = Adenine phosphorothioate
  modified_base 61: mod_base = OTHER; note = Cytosine phosphorothioate

SEQ ID NO: 870 - DNA, 62 bp, synthetic construct; identical to SEQ ID NO: 231
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Cytosine phosphorothioate
  modified_base 55: mod_base = OTHER; note = Guanosine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Adenine phosphorothioate

SEQ ID NO: 871 - DNA, 62 bp, synthetic construct; identical to SEQ ID NO: 232
  source 1..62: mol_type = other DNA
  modified_base 46: mod_base = OTHER; note = Adenine phosphorothioate
  modified_base 47: mod_base = OTHER; note = Cytosine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Cytosine phosphorothioate
  modified_base 55: mod_base = OTHER; note = Guanosine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Adenine phosphorothioate

SEQ ID NO: 872 - DNA, 62 bp, synthetic construct; identical to SEQ ID NO: 233
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Cytosine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Guanosine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Cytosine phosphorothioate
  modified_base 55: mod_base = OTHER; note = Guanosine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Adenine phosphorothioate

SEQ ID NO: 873 - DNA, 62 bp, synthetic construct; identical to SEQ ID NO: 234
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Guanosine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Cytosine phosphorothioate
  modified_base 55: mod_base = OTHER; note = Guanosine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Adenine phosphorothioate

SEQ ID NO: 874 - DNA, 62 bp, synthetic construct; identical to SEQ ID NO: 235
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Cytosine phosphorothioate
  modified_base 55: mod_base = OTHER; note = Guanosine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Cytosine phosphorothioate

SEQ ID NO: 875 - DNA, 62 bp, synthetic construct; identical to SEQ ID NO: 236
  source 1..62: mol_type = other DNA
  modified_base 46: mod_base = OTHER; note = Adenine phosphorothioate
  modified_base 47: mod_base = OTHER; note = Cytosine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Cytosine phosphorothioate
  modified_base 55: mod_base = OTHER; note = Guanosine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Cytosine phosphorothioate

SEQ ID NO: 876 - DNA, 62 bp, synthetic construct; identical to SEQ ID NO: 237
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Cytosine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Guanosine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Cytosine phosphorothioate
  modified_base 55: mod_base = OTHER; note = Guanosine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Cytosine phosphorothioate

SEQ ID NO: 877 - DNA, 62 bp, synthetic construct; identical to SEQ ID NO: 238
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Guanosine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Cytosine phosphorothioate
  modified_base 55: mod_base = OTHER; note = Guanosine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Cytosine phosphorothioate

SEQ ID NO: 878 - DNA, 62 bp, synthetic construct; identical to SEQ ID NO: 239
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Cytosine phosphorothioate
  modified_base 55: mod_base = OTHER; note = Guanosine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Cytosine phosphorothioate
  modified_base 60: mod_base = OTHER; note = Adenine phosphorothioate
  modified_base 61: mod_base = OTHER; note = Cytosine phosphorothioate

SEQ ID NO: 879 - DNA, 62 bp, synthetic construct; identical to SEQ ID NO: 240
  source 1..62: mol_type = other DNA
  modified_base 46: mod_base = OTHER; note = Adenine phosphorothioate
  modified_base 47: mod_base = OTHER; note = Cytosine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Cytosine phosphorothioate
  modified_base 55: mod_base = OTHER; note = Guanosine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Cytosine phosphorothioate
  modified_base 60: mod_base = OTHER; note = Adenine phosphorothioate
  modified_base 61: mod_base = OTHER; note = Cytosine phosphorothioate

SEQ ID NO: 880 - DNA, 62 bp, synthetic construct; identical to SEQ ID NO: 241
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Cytosine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Guanosine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Cytosine phosphorothioate
  modified_base 55: mod_base = OTHER; note = Guanosine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Cytosine phosphorothioate
  modified_base 60: mod_base = OTHER; note = Adenine phosphorothioate
  modified_base 61: mod_base = OTHER; note = Cytosine phosphorothioate

SEQ ID NO: 881 - DNA, 62 bp, synthetic construct; identical to SEQ ID NO: 242
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Guanosine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Cytosine phosphorothioate
  modified_base 55: mod_base = OTHER; note = Guanosine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Cytosine phosphorothioate
  modified_base 60: mod_base = OTHER; note = Adenine phosphorothioate
  modified_base 61: mod_base = OTHER; note = Cytosine phosphorothioate

SEQ ID NO: 882 - DNA, 62 bp, synthetic construct; identical to SEQ ID NO: 243
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Cytosine phosphorothioate
  modified_base 55: mod_base = OTHER; note = Guanosine phosphorothioate
  modified_base 56: mod_base = OTHER; note = Guanosine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Cytosine phosphorothioate
  modified_base 60: mod_base = OTHER; note = Adenine phosphorothioate
  modified_base 61: mod_base = OTHER; note = Cytosine phosphorothioate

SEQ ID NO: 883 - DNA, 62 bp, synthetic construct; identical to SEQ ID NO: 244
  source 1..62: mol_type = other DNA
  modified_base 46: mod_base = OTHER; note = Adenine phosphorothioate
  modified_base 47: mod_base = OTHER; note = Cytosine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Cytosine phosphorothioate
  modified_base 55: mod_base = OTHER; note = Guanosine phosphorothioate
  modified_base 56: mod_base = OTHER; note = Guanosine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Cytosine phosphorothioate
  modified_base 60: mod_base = OTHER; note = Adenine phosphorothioate
  modified_base 61: mod_base = OTHER; note = Cytosine phosphorothioate

SEQ ID NO: 884 - DNA, 62 bp, synthetic construct; identical to SEQ ID NO: 245
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Cytosine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Guanosine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Cytosine phosphorothioate
  modified_base 55: mod_base = OTHER; note = Guanosine phosphorothioate
  modified_base 56: mod_base = OTHER; note = Guanosine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Cytosine phosphorothioate
  modified_base 60: mod_base = OTHER; note = Adenine phosphorothioate
  modified_base 61: mod_base = OTHER; note = Cytosine phosphorothioate

SEQ ID NO: 885 - DNA, 62 bp, synthetic construct; identical to SEQ ID NO: 246
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Guanosine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Cytosine phosphorothioate
  modified_base 55: mod_base = OTHER; note = Guanosine phosphorothioate
  modified_base 56: mod_base = OTHER; note = Guanosine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Cytosine phosphorothioate
  modified_base 60: mod_base = OTHER; note = Adenine phosphorothioate
  modified_base 61: mod_base = OTHER; note = Cytosine phosphorothioate

SEQ ID NO: 886 - DNA, 62 bp, synthetic construct; identical to SEQ ID NO: 247
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Cytosine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Guanosine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Adenine phosphorothioate

SEQ ID NO: 887 - DNA, 62 bp, synthetic construct; identical to SEQ ID NO: 248
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Cytosine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Guanosine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Adenine phosphorothioate

SEQ ID NO: 888 - DNA, 62 bp, synthetic construct; identical to SEQ ID NO: 249
  source 1..62: mol_type = other DNA
  modified_base 46: mod_base = OTHER; note = Cytosine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Guanosine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Cytosine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Guanosine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Adenine phosphorothioate

SEQ ID NO: 889 - DNA, 62 bp, synthetic construct; identical to SEQ ID NO: 250
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Guanosine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Cytosine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Guanosine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Adenine phosphorothioate

SEQ ID NO: 890 - DNA, 62 bp, synthetic construct; identical to SEQ ID NO: 251
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Cytosine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Guanosine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Cytosine phosphorothioate

SEQ ID NO: 891 - DNA, 62 bp, synthetic construct; identical to SEQ ID NO: 252
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Cytosine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Guanosine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Cytosine phosphorothioate

SEQ ID NO: 892 - DNA, 62 bp, synthetic construct; identical to SEQ ID NO: 253
  source 1..62: mol_type = other DNA
  modified_base 46: mod_base = OTHER; note = Cytosine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Guanosine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Cytosine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Guanosine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Cytosine phosphorothioate

SEQ ID NO: 893 - DNA, 62 bp, synthetic construct; identical to SEQ ID NO: 254
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Guanosine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Cytosine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Guanosine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Cytosine phosphorothioate

SEQ ID NO: 894 - DNA, 62 bp, synthetic construct; identical to SEQ ID NO: 255
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Cytosine phosphorothioate
  modified_base 53: mod_base = OTHER; note = Guanosine phosphorothioate
  modified_base 54: mod_base = OTHER; note = Thymine phosphorothioate
  modified_base 55: mod_base = OTHER; note = Guanosine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Cytosine phosphorothioate

SEQ ID NO: 895 - DNA, 62 bp, synthetic construct; identical to SEQ ID NO: 256
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Cytosine phosphorothioate
  modified_base 53: mod_base = OTHER; note = Guanosine phosphorothioate
  modified_base 54: mod_base = OTHER; note = Thymine phosphorothioate
  modified_base 55: mod_base = OTHER; note = Guanosine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Cytosine phosphorothioate

SEQ ID NO: 896 - DNA, 62 bp, synthetic construct; identical to SEQ ID NO: 257
  source 1..62: mol_type = other DNA
  modified_base 46: mod_base = OTHER; note = Cytosine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Guanosine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Cytosine phosphorothioate
  modified_base 53: mod_base = OTHER; note = Guanosine phosphorothioate
  modified_base 54: mod_base = OTHER; note = Thymine phosphorothioate
  modified_base 55: mod_base = OTHER; note = Guanosine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Cytosine phosphorothioate

SEQ ID NO: 897 - DNA, 62 bp, synthetic construct; identical to SEQ ID NO: 258
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Guanosine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Cytosine phosphorothioate
  modified_base 53: mod_base = OTHER; note = Guanosine phosphorothioate
  modified_base 54: mod_base = OTHER; note = Thymine phosphorothioate
  modified_base 55: mod_base = OTHER; note = Guanosine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Cytosine phosphorothioate

SEQ ID NO: 898 - DNA, 62 bp, synthetic construct; identical to SEQ ID NO: 259
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Cytosine phosphorothioate
  modified_base 53: mod_base = OTHER; note = Guanosine phosphorothioate
  modified_base 54: mod_base = OTHER; note = Thymine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Cytosine phosphorothioate
  modified_base 61: mod_base = OTHER; note = Cytosine phosphorothioate

SEQ ID NO: 899 - DNA, 62 bp, synthetic construct; identical to SEQ ID NO: 260
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Cytosine phosphorothioate
  modified_base 53: mod_base = OTHER; note = Guanosine phosphorothioate
  modified_base 54: mod_base = OTHER; note = Thymine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Cytosine phosphorothioate
  modified_base 61: mod_base = OTHER; note = Cytosine phosphorothioate

SEQ ID NO: 900 - DNA, 62 bp, synthetic construct; identical to SEQ ID NO: 261
  source 1..62: mol_type = other DNA
  modified_base 46: mod_base = OTHER; note = Cytosine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Guanosine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Cytosine phosphorothioate
  modified_base 53: mod_base = OTHER; note = Guanosine phosphorothioate
  modified_base 54: mod_base = OTHER; note = Thymine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Cytosine phosphorothioate
  modified_base 61: mod_base = OTHER; note = Cytosine phosphorothioate

SEQ ID NO: 901 - DNA, 62 bp, synthetic construct; identical to SEQ ID NO: 262
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Guanosine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Cytosine phosphorothioate
  modified_base 53: mod_base = OTHER; note = Guanosine phosphorothioate
  modified_base 54: mod_base = OTHER; note = Thymine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Cytosine phosphorothioate
  modified_base 61: mod_base = OTHER; note = Cytosine phosphorothioate

SEQ ID NO: 902 - DNA, 62 bp, synthetic construct; identical to SEQ ID NO: 263
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Cytosine phosphorothioate
  modified_base 53: mod_base = OTHER; note = Guanosine phosphorothioate
  modified_base 54: mod_base = OTHER; note = Thymine phosphorothioate
  modified_base 55: mod_base = OTHER; note = Guanosine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Cytosine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Cytosine phosphorothioate

SEQ ID NO: 903 - DNA, 62 bp, synthetic construct; identical to SEQ ID NO: 264
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Cytosine phosphorothioate
  modified_base 53: mod_base = OTHER; note = Guanosine phosphorothioate
  modified_base 54: mod_base = OTHER; note = Thymine phosphorothioate
  modified_base 55: mod_base = OTHER; note = Guanosine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Cytosine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Cytosine phosphorothioate

SEQ ID NO: 904 - DNA, 62 bp, synthetic construct; identical to SEQ ID NO: 265
  source 1..62: mol_type = other DNA
  modified_base 46: mod_base = OTHER; note = Cytosine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Guanosine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Cytosine phosphorothioate
  modified_base 53: mod_base = OTHER; note = Guanosine phosphorothioate
  modified_base 54: mod_base = OTHER; note = Thymine phosphorothioate
  modified_base 55: mod_base = OTHER; note = Guanosine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Cytosine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Cytosine phosphorothioate

SEQ ID NO: 905 - DNA, 62 bp, synthetic construct; identical to SEQ ID NO: 266
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Guanosine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Cytosine phosphorothioate
  modified_base 53: mod_base = OTHER; note = Guanosine phosphorothioate
  modified_base 54: mod_base = OTHER; note = Thymine phosphorothioate
  modified_base 55: mod_base = OTHER; note = Guanosine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Cytosine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Cytosine phosphorothioate

SEQ ID NO: 906 - DNA, 68 bp, synthetic construct; identical to SEQ ID NO: 267
  source 1..68: mol_type = other DNA
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Guanosine phosphorothioate
  modified_base 62: mod_base = OTHER; note = Thymine phosphorothioate
  modified_base 63: mod_base = OTHER; note = Adenine phosphorothioate
  modified_base 64: mod_base = OTHER; note = Thymine phosphorothioate

SEQ ID NO: 907 - DNA, 68 bp, synthetic construct; identical to SEQ ID NO: 268
  source 1..68: mol_type = other DNA
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Guanosine phosphorothioate
  modified_base 62: mod_base = OTHER; note = Thymine phosphorothioate
  modified_base 63: mod_base = OTHER; note = Adenine phosphorothioate
  modified_base 64: mod_base = OTHER; note = Thymine phosphorothioate

SEQ ID NO: 908 - DNA, 68 bp, synthetic construct; identical to SEQ ID NO: 269
  source 1..68: mol_type = other DNA
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Cytosine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Guanosine phosphorothioate
  modified_base 62: mod_base = OTHER; note = Thymine phosphorothioate
  modified_base 63: mod_base = OTHER; note = Adenine phosphorothioate
  modified_base 64: mod_base = OTHER; note = Thymine phosphorothioate

SEQ ID NO: 909 - DNA, 68 bp, synthetic construct; identical to SEQ ID NO: 270
  source 1..68: mol_type = other DNA
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Cytosine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Guanosine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Guanosine phosphorothioate
  modified_base 62: mod_base = OTHER; note = Thymine phosphorothioate
  modified_base 63: mod_base = OTHER; note = Adenine phosphorothioate
  modified_base 64: mod_base = OTHER; note = Thymine phosphorothioate

SEQ ID NO: 910 - DNA, 68 bp, synthetic construct; identical to SEQ ID NO: 271
  source 1..68: mol_type = other DNA
  modified_base 49: mod_base = OTHER; note = Adenine phosphorothioate
  modified_base 50: mod_base = OTHER; note = Cytosine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Guanosine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Guanosine phosphorothioate
  modified_base 62: mod_base = OTHER; note = Thymine phosphorothioate
  modified_base 63: mod_base = OTHER; note = Adenine phosphorothioate
  modified_base 64: mod_base = OTHER; note = Thymine phosphorothioate

SEQ ID NO: 911 - DNA, 68 bp, synthetic construct; identical to SEQ ID NO: 272
  source 1..68: mol_type = other DNA
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Guanosine phosphorothioate
  modified_base 62: mod_base = OTHER; note = Thymine phosphorothioate
  modified_base 63: mod_base = OTHER; note = Adenine phosphorothioate
  modified_base 64: mod_base = OTHER; note = Thymine phosphorothioate

SEQ ID NO: 912 - DNA, 68 bp, synthetic construct; identical to SEQ ID NO: 273
  source 1..68: mol_type = other DNA
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Guanosine phosphorothioate
  modified_base 62: mod_base = OTHER; note = Thymine phosphorothioate
  modified_base 63: mod_base = OTHER; note = Adenine phosphorothioate
  modified_base 64: mod_base = OTHER; note = Thymine phosphorothioate

SEQ ID NO: 913 - DNA, 68 bp, synthetic construct; identical to SEQ ID NO: 274
  source 1..68: mol_type = other DNA
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Cytosine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Guanosine phosphorothioate
  modified_base 62: mod_base = OTHER; note = Thymine phosphorothioate
  modified_base 63: mod_base = OTHER; note = Adenine phosphorothioate
  modified_base 64: mod_base = OTHER; note = Thymine phosphorothioate

SEQ ID NO: 914 - DNA, 68 bp, synthetic construct; identical to SEQ ID NO: 275
  source 1..68: mol_type = other DNA
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Cytosine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Guanosine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Guanosine phosphorothioate
  modified_base 62: mod_base = OTHER; note = Thymine phosphorothioate
  modified_base 63: mod_base = OTHER; note = Adenine phosphorothioate
  modified_base 64: mod_base = OTHER; note = Thymine phosphorothioate

SEQ ID NO: 915 - DNA, 68 bp, synthetic construct; identical to SEQ ID NO: 276
  source 1..68: mol_type = other DNA
  modified_base 49: mod_base = OTHER; note = Adenine phosphorothioate
  modified_base 50: mod_base = OTHER; note = Cytosine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Guanosine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Guanosine phosphorothioate
  modified_base 62: mod_base = OTHER; note = Thymine phosphorothioate
  modified_base 63: mod_base = OTHER; note = Adenine phosphorothioate
  modified_base 64: mod_base = OTHER; note = Thymine phosphorothioate

SEQ ID NO: 916 - DNA, 68 bp, synthetic construct; identical to SEQ ID NO: 277
  source 1..68: mol_type = other DNA
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Guanosine phosphorothioate
  modified_base 62: mod_base = OTHER; note = Thymine phosphorothioate
  modified_base 63: mod_base = OTHER; note = Adenine phosphorothioate
  modified_base 64: mod_base = OTHER; note = Thymine phosphorothioate

SEQ ID NO: 917 - DNA, 68 bp, synthetic construct; identical to SEQ ID NO: 278
  source 1..68: mol_type = other DNA
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Guanosine phosphorothioate
  modified_base 62: mod_base = OTHER; note = Thymine phosphorothioate
  modified_base 63: mod_base = OTHER; note = Adenine phosphorothioate
  modified_base 64: mod_base = OTHER; note = Thymine phosphorothioate

SEQ ID NO: 918 - DNA, 68 bp, synthetic construct; identical to SEQ ID NO: 279
  source 1..68: mol_type = other DNA
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Cytosine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Guanosine phosphorothioate
  modified_base 62: mod_base = OTHER; note = Thymine phosphorothioate
  modified_base 63: mod_base = OTHER; note = Adenine phosphorothioate
  modified_base 64: mod_base = OTHER; note = Thymine phosphorothioate

SEQ ID NO: 919 - DNA, 68 bp, synthetic construct; identical to SEQ ID NO: 280
  source 1..68: mol_type = other DNA
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Cytosine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Guanosine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Guanosine phosphorothioate
  modified_base 62: mod_base = OTHER; note = Thymine phosphorothioate
  modified_base 63: mod_base = OTHER; note = Adenine phosphorothioate
  modified_base 64: mod_base = OTHER; note = Thymine phosphorothioate

SEQ ID NO: 920 - DNA, 68 bp, synthetic construct; identical to SEQ ID NO: 281
  source 1..68: mol_type = other DNA
  modified_base 49: mod_base = OTHER; note = Adenine phosphorothioate
  modified_base 50: mod_base = OTHER; note = Cytosine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Guanosine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Guanosine phosphorothioate
  modified_base 62: mod_base = OTHER; note = Thymine phosphorothioate
  modified_base 63: mod_base = OTHER; note = Adenine phosphorothioate
  modified_base 64: mod_base = OTHER; note = Thymine phosphorothioate

SEQ ID NO: 921 - DNA, 68 bp, synthetic construct; identical to SEQ ID NO: 282
  source 1..68: mol_type = other DNA
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Guanosine phosphorothioate
  modified_base 62: mod_base = OTHER; note = Guanosine phosphorothioate
  modified_base 63: mod_base = OTHER; note = Adenine phosphorothioate
  modified_base 64: mod_base = OTHER; note = Thymine phosphorothioate

SEQ ID NO: 922 - DNA, 68 bp, synthetic construct; identical to SEQ ID NO: 283
  source 1..68: mol_type = other DNA
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Guanosine phosphorothioate
  modified_base 62: mod_base = OTHER; note = Guanosine phosphorothioate
  modified_base 63: mod_base = OTHER; note = Adenine phosphorothioate
  modified_base 64: mod_base = OTHER; note = Thymine phosphorothioate

SEQ ID NO: 923 - DNA, 68 bp, synthetic construct; identical to SEQ ID NO: 284
  source 1..68: mol_type = other DNA
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Cytosine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Guanosine phosphorothioate
  modified_base 62: mod_base = OTHER; note = Guanosine phosphorothioate
  modified_base 63: mod_base = OTHER; note = Adenine phosphorothioate
  modified_base 64: mod_base = OTHER; note = Thymine phosphorothioate

SEQ ID NO: 924 - DNA, 68 bp, synthetic construct; identical to SEQ ID NO: 285
  source 1..68: mol_type = other DNA
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Cytosine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Guanosine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Guanosine phosphorothioate
  modified_base 62: mod_base = OTHER; note = Guanosine phosphorothioate
  modified_base 63: mod_base = OTHER; note = Adenine phosphorothioate
  modified_base 64: mod_base = OTHER; note = Thymine phosphorothioate

SEQ ID NO: 925 - DNA, 68 bp, synthetic construct; identical to SEQ ID NO: 286
  source 1..68: mol_type = other DNA
  modified_base 49: mod_base = OTHER; note = Adenine phosphorothioate
  modified_base 50: mod_base = OTHER; note = Cytosine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Guanosine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Guanosine phosphorothioate
  modified_base 62: mod_base = OTHER; note = Guanosine phosphorothioate
  modified_base 63: mod_base = OTHER; note = Adenine phosphorothioate
  modified_base 64: mod_base = OTHER; note = Thymine phosphorothioate

SEQ ID NO: 926 - DNA, 72 bp, synthetic construct; identical to SEQ ID NO: 287
  source 1..72: mol_type = other DNA
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Thymine phosphorothioate
  modified_base 62: mod_base = OTHER; note = Adenine phosphorothioate
  modified_base 63: mod_base = OTHER; note = Guanosine phosphorothioate
  modified_base 64: mod_base = OTHER; note = Thymine phosphorothioate
  modified_base 65: mod_base = OTHER; note = Guanosine phosphorothioate
  modified_base 66: mod_base = OTHER; note = Adenine phosphorothioate

SEQ ID NO: 927 - DNA, 72 bp, synthetic construct; identical to SEQ ID NO: 288
  source 1..72: mol_type = other DNA
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Thymine phosphorothioate
  modified_base 62: mod_base = OTHER; note = Cytosine phosphorothioate
  modified_base 63: mod_base = OTHER; note = Adenine phosphorothioate
  modified_base 64: mod_base = OTHER; note = Thymine phosphorothioate
  modified_base 65: mod_base = OTHER; note = Guanosine phosphorothioate
  modified_base 66: mod_base = OTHER; note = Thymine phosphorothioate

SEQ ID NO: 928 - DNA, 72 bp, synthetic construct; identical to SEQ ID NO: 289
  source 1..72: mol_type = other DNA
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Cytosine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Thymine phosphorothioate
  modified_base 62: mod_base = OTHER; note = Cytosine phosphorothioate
  modified_base 63: mod_base = OTHER; note = Adenine phosphorothioate
  modified_base 64: mod_base = OTHER; note = Thymine phosphorothioate
  modified_base 65: mod_base = OTHER; note = Guanosine phosphorothioate
  modified_base 66: mod_base = OTHER; note = Thymine phosphorothioate

SEQ ID NO: 929 - DNA, 72 bp, synthetic construct; identical to SEQ ID NO: 290
  source 1..72: mol_type = other DNA
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Adenine phosphorothioate
  modified_base 56: mod_base = OTHER; note = Cytosine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Guanosine phosphorothioate
  modified_base 60: mod_base = OTHER; note = Adenine phosphorothioate
  modified_base 61: mod_base = OTHER; note = Thymine phosphorothioate
  modified_base 62: mod_base = OTHER; note = Cytosine phosphorothioate
  modified_base 63: mod_base = OTHER; note = Adenine phosphorothioate
  modified_base 64: mod_base = OTHER; note = Thymine phosphorothioate
  modified_base 65: mod_base = OTHER; note = Guanosine phosphorothioate
  modified_base 66: mod_base = OTHER; note = Thymine phosphorothioate

SEQ ID NO: 930 - DNA, 72 bp, synthetic construct; identical to SEQ ID NO: 291
  source 1..72: mol_type = other DNA
  modified_base 51: mod_base = OTHER; note = Adenine phosphorothioate
  modified_base 52: mod_base = OTHER; note = Cytosine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Guanosine phosphorothioate
  modified_base 60: mod_base = OTHER; note = Adenine phosphorothioate
  modified_base 61: mod_base = OTHER; note = Thymine phosphorothioate
  modified_base 62: mod_base = OTHER; note = Cytosine phosphorothioate
  modified_base 63: mod_base = OTHER; note = Adenine phosphorothioate
  modified_base 64: mod_base = OTHER; note = Thymine phosphorothioate
  modified_base 65: mod_base = OTHER; note = Guanosine phosphorothioate
  modified_base 66: mod_base = OTHER; note = Thymine phosphorothioate

SEQ ID NO: 931 - DNA, 72 bp, synthetic construct; identical to SEQ ID NO: 292
  source 1..72: mol_type = other DNA
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Thymine phosphorothioate
  modified_base 62: mod_base = OTHER; note = Adenine phosphorothioate
  modified_base 63: mod_base = OTHER; note = Guanosine phosphorothioate
  modified_base 64: mod_base = OTHER; note = Thymine phosphorothioate
  modified_base 65: mod_base = OTHER; note = Guanosine phosphorothioate
  modified_base 66: mod_base = OTHER; note = Thymine phosphorothioate

SEQ ID NO: 932 - DNA, 72 bp, synthetic construct; identical to SEQ ID NO: 293
  source 1..72: mol_type = other DNA
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Thymine phosphorothioate
  modified_base 62: mod_base = OTHER; note = Cytosine phosphorothioate
  modified_base 63: mod_base = OTHER; note = Adenine phosphorothioate
  modified_base 64: mod_base = OTHER; note = Thymine phosphorothioate
  modified_base 65: mod_base = OTHER; note = Guanosine phosphorothioate
  modified_base 66: mod_base = OTHER; note = Thymine phosphorothioate

SEQ ID NO: 933 - DNA, 72 bp, synthetic construct; identical to SEQ ID NO: 294
  source 1..72: mol_type = other DNA
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Cytosine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Thymine phosphorothioate
  modified_base 62: mod_base = OTHER; note = Cytosine phosphorothioate
  modified_base 63: mod_base = OTHER; note = Adenine phosphorothioate
  modified_base 64: mod_base = OTHER; note = Thymine phosphorothioate
  modified_base 65: mod_base = OTHER; note = Guanosine phosphorothioate
  modified_base 66: mod_base = OTHER; note = Thymine phosphorothioate

SEQ ID NO: 934 - DNA, 72 bp, synthetic construct; identical to SEQ ID NO: 295
  source 1..72: mol_type = other DNA
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Adenine phosphorothioate
  modified_base 56: mod_base = OTHER; note = Cytosine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Guanosine phosphorothioate
  modified_base 60: mod_base = OTHER; note = Adenine phosphorothioate
  modified_base 61: mod_base = OTHER; note = Thymine phosphorothioate
  modified_base 62: mod_base = OTHER; note = Cytosine phosphorothioate
  modified_base 63: mod_base = OTHER; note = Adenine phosphorothioate
  modified_base 64: mod_base = OTHER; note = Thymine phosphorothioate
  modified_base 65: mod_base = OTHER; note = Guanosine phosphorothioate
  modified_base 66: mod_base = OTHER; note = Thymine phosphorothioate

SEQ ID NO: 935 - DNA, 72 bp, synthetic construct; identical to SEQ ID NO: 296
  source 1..72: mol_type = other DNA
  modified_base 51: mod_base = OTHER; note = Adenine phosphorothioate
  modified_base 52: mod_base = OTHER; note = Cytosine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Guanosine phosphorothioate
  modified_base 60: mod_base = OTHER; note = Adenine phosphorothioate
  modified_base 61: mod_base = OTHER; note = Thymine phosphorothioate
  modified_base 62: mod_base = OTHER; note = Cytosine phosphorothioate
  modified_base 63: mod_base = OTHER; note = Adenine phosphorothioate
  modified_base 64: mod_base = OTHER; note = Thymine phosphorothioate
  modified_base 65: mod_base = OTHER; note = Guanosine phosphorothioate
  modified_base 66: mod_base = OTHER; note = Thymine phosphorothioate

SEQ ID NO: 936 - DNA, 72 bp, synthetic construct; identical to SEQ ID NO: 297
  source 1..72: mol_type = other DNA
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Thymine phosphorothioate
  modified_base 62: mod_base = OTHER; note = Adenine phosphorothioate
  modified_base 63: mod_base = OTHER; note = Guanosine phosphorothioate
  modified_base 64: mod_base = OTHER; note = Thymine phosphorothioate
  modified_base 65: mod_base = OTHER; note = Adenine phosphorothioate
  modified_base 66: mod_base = OTHER; note = Thymine phosphorothioate

SEQ ID NO: 937 - DNA, 72 bp, synthetic construct; identical to SEQ ID NO: 298
  source 1..72: mol_type = other DNA
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Thymine phosphorothioate
  modified_base 62: mod_base = OTHER; note = Cytosine phosphorothioate
  modified_base 63: mod_base = OTHER; note = Guanosine phosphorothioate
  modified_base 64: mod_base = OTHER; note = Thymine phosphorothioate
  modified_base 65: mod_base = OTHER; note = Guanosine phosphorothioate
  modified_base 66: mod_base = OTHER; note = Thymine phosphorothioate

SEQ ID NO: 938 - DNA, 72 bp, synthetic construct; identical to SEQ ID NO: 299
  source 1..72: mol_type = other DNA
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Cytosine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Thymine phosphorothioate
  modified_base 62: mod_base = OTHER; note = Cytosine phosphorothioate
  modified_base 63: mod_base = OTHER; note = Guanosine phosphorothioate
  modified_base 64: mod_base = OTHER; note = Thymine phosphorothioate
  modified_base 65: mod_base = OTHER; note = Guanosine phosphorothioate
  modified_base 66: mod_base = OTHER; note = Thymine phosphorothioate

SEQ ID NO: 939 - DNA, 72 bp, synthetic construct; identical to SEQ ID NO: 300
  source 1..72: mol_type = other DNA
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Adenine phosphorothioate
  modified_base 56: mod_base = OTHER; note = Cytosine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Guanosine phosphorothioate
  modified_base 60: mod_base = OTHER; note = Adenine phosphorothioate
  modified_base 61: mod_base = OTHER; note = Thymine phosphorothioate
  modified_base 62: mod_base = OTHER; note = Cytosine phosphorothioate
  modified_base 63: mod_base = OTHER; note = Guanosine phosphorothioate
  modified_base 64: mod_base = OTHER; note = Thymine phosphorothioate
  modified_base 65: mod_base = OTHER; note = Guanosine phosphorothioate
  modified_base 66: mod_base = OTHER; note = Thymine phosphorothioate

SEQ ID NO: 940 - DNA, 72 bp, synthetic construct; identical to SEQ ID NO: 301
  source 1..72: mol_type = other DNA
  modified_base 51: mod_base = OTHER; note = Adenine phosphorothioate
  modified_base 52: mod_base = OTHER; note = Cytosine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Guanosine phosphorothioate
  modified_base 60: mod_base = OTHER; note = Adenine phosphorothioate
  modified_base 61: mod_base = OTHER; note = Thymine phosphorothioate
  modified_base 62: mod_base = OTHER; note = Cytosine phosphorothioate
  modified_base 63: mod_base = OTHER; note = Guanosine phosphorothioate
  modified_base 64: mod_base = OTHER; note = Thymine phosphorothioate
  modified_base 65: mod_base = OTHER; note = Guanosine phosphorothioate
  modified_base 66: mod_base = OTHER; note = Thymine phosphorothioate

SEQ ID NO: 941 - DNA, 72 bp, synthetic construct; identical to SEQ ID NO: 302
  source 1..72: mol_type = other DNA
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Thymine phosphorothioate
  modified_base 62: mod_base = OTHER; note = Cytosine phosphorothioate
  modified_base 63: mod_base = OTHER; note = Guanosine phosphorothioate
  modified_base 64: mod_base = OTHER; note = Thymine phosphorothioate
  modified_base 65: mod_base = OTHER; note = Adenine phosphorothioate
  modified_base 66: mod_base = OTHER; note = Thymine phosphorothioate

SEQ ID NO: 942 - DNA, 72 bp, synthetic construct; identical to SEQ ID NO: 303
  source 1..72: mol_type = other DNA
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Cytosine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Thymine phosphorothioate
  modified_base 62: mod_base = OTHER; note = Cytosine phosphorothioate
  modified_base 63: mod_base = OTHER; note = Guanosine phosphorothioate
  modified_base 64: mod_base = OTHER; note = Thymine phosphorothioate
  modified_base 65: mod_base = OTHER; note = Adenine phosphorothioate
  modified_base 66: mod_base = OTHER; note = Thymine phosphorothioate

SEQ ID NO: 943 - DNA, 72 bp, synthetic construct; identical to SEQ ID NO: 304
  source 1..72: mol_type = other DNA
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Adenine phosphorothioate
  modified_base 56: mod_base = OTHER; note = Cytosine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Guanosine phosphorothioate
  modified_base 60: mod_base = OTHER; note = Adenine phosphorothioate
  modified_base 61: mod_base = OTHER; note = Thymine phosphorothioate
  modified_base 62: mod_base = OTHER; note = Cytosine phosphorothioate
  modified_base 63: mod_base = OTHER; note = Guanosine phosphorothioate
  modified_base 64: mod_base = OTHER; note = Thymine phosphorothioate
  modified_base 65: mod_base = OTHER; note = Adenine phosphorothioate
  modified_base 66: mod_base = OTHER; note = Thymine phosphorothioate

SEQ ID NO: 944 - DNA, 72 bp, synthetic construct; identical to SEQ ID NO: 305
  source 1..72: mol_type = other DNA
  modified_base 51: mod_base = OTHER; note = Adenine phosphorothioate
  modified_base 52: mod_base = OTHER; note = Cytosine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Guanosine phosphorothioate
  modified_base 60: mod_base = OTHER; note = Adenine phosphorothioate
  modified_base 61: mod_base = OTHER; note = Thymine phosphorothioate
  modified_base 62: mod_base = OTHER; note = Cytosine phosphorothioate
  modified_base 63: mod_base = OTHER; note = Guanosine phosphorothioate
  modified_base 64: mod_base = OTHER; note = Thymine phosphorothioate
  modified_base 65: mod_base = OTHER; note = Adenine phosphorothioate
  modified_base 66: mod_base = OTHER; note = Thymine phosphorothioate

SEQ ID NO: 945 - DNA, 66 bp, synthetic construct; identical to SEQ ID NO: 306
  source 1..66: mol_type = other DNA
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Cytosine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Adenine phosphorothioate

SEQ ID NO: 946 - DNA, 66 bp, synthetic construct; identical to SEQ ID NO: 307
  source 1..66: mol_type = other DNA
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Cytosine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Cytosine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Adenine phosphorothioate

SEQ ID NO: 947 - DNA, 66 bp, synthetic construct; identical to SEQ ID NO: 308
  source 1..66: mol_type = other DNA
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Cytosine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Guanosine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Cytosine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Adenine phosphorothioate

SEQ ID NO: 948 - DNA, 66 bp, synthetic construct; identical to SEQ ID NO: 309
  source 1..66: mol_type = other DNA
  modified_base 48: mod_base = OTHER; note = Cytosine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Guanosine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Cytosine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Adenine phosphorothioate

SEQ ID NO: 949 - DNA, 66 bp, synthetic construct; identical to SEQ ID NO: 310
  source 1..66: mol_type = other DNA
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Cytosine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Adenine phosphorothioate

SEQ ID NO: 950 - DNA, 66 bp, synthetic construct; identical to SEQ ID NO: 311
  source 1..66: mol_type = other DNA
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Cytosine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Cytosine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Adenine phosphorothioate

SEQ ID NO: 951 - DNA, 66 bp, synthetic construct; identical to SEQ ID NO: 312
  source 1..66: mol_type = other DNA
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Cytosine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Guanosine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Cytosine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Adenine phosphorothioate

SEQ ID NO: 952 - DNA, 66 bp, synthetic construct; identical to SEQ ID NO: 313
  source 1..66: mol_type = other DNA
  modified_base 48: mod_base = OTHER; note = Cytosine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Guanosine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Cytosine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Adenine phosphorothioate

SEQ ID NO: 953 - DNA, 66 bp, synthetic construct; identical to SEQ ID NO: 314
  source 1..66: mol_type = other DNA
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Cytosine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Cytosine phosphorothioate

SEQ ID NO: 954 - DNA, 66 bp, synthetic construct; identical to SEQ ID NO: 315
  source 1..66: mol_type = other DNA
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Cytosine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Cytosine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Cytosine phosphorothioate

SEQ ID NO: 955 - DNA, 66 bp, synthetic construct; identical to SEQ ID NO: 316
  source 1..66: mol_type = other DNA
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Cytosine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Guanosine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Cytosine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Cytosine phosphorothioate

SEQ ID NO: 956 - DNA, 66 bp, synthetic construct; identical to SEQ ID NO: 317
  source 1..66: mol_type = other DNA
  modified_base 48: mod_base = OTHER; note = Cytosine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Guanosine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Cytosine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Cytosine phosphorothioate

SEQ ID NO: 957 - DNA, 66 bp, synthetic construct; identical to SEQ ID NO: 318
  source 1..66: mol_type = other DNA
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Cytosine phosphorothioate
  modified_base 59: mod_base = OTHER; note = Guanosine phosphorothioate
  modified_base 60: mod_base = OTHER; note = Guanosine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Cytosine phosphorothioate

SEQ ID NO: 958 - DNA, 66 bp, synthetic construct; identical to SEQ ID NO: 319
  source 1..66: mol_type = other DNA
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Cytosine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Cytosine phosphorothioate
  modified_base 59: mod_base = OTHER; note = Guanosine phosphorothioate
  modified_base 60: mod_base = OTHER; note = Guanosine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Cytosine phosphorothioate

SEQ ID NO: 959 - DNA, 66 bp, synthetic construct; identical to SEQ ID NO: 320
  source 1..66: mol_type = other DNA
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Cytosine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Guanosine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Cytosine phosphorothioate
  modified_base 59: mod_base = OTHER; note = Guanosine phosphorothioate
  modified_base 60: mod_base = OTHER; note = Guanosine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Cytosine phosphorothioate

SEQ ID NO: 960 - DNA, 66 bp, synthetic construct; identical to SEQ ID NO: 321
  source 1..66: mol_type = other DNA
  modified_base 48: mod_base = OTHER; note = Cytosine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Guanosine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Cytosine phosphorothioate
  modified_base 59: mod_base = OTHER; note = Guanosine phosphorothioate
  modified_base 60: mod_base = OTHER; note = Guanosine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Cytosine phosphorothioate

SEQ ID NO: 961 - DNA, 70 bp, synthetic construct; identical to SEQ ID NO: 322
  source 1..70: mol_type = other DNA
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Guanosine phosphorothioate
  modified_base 64: mod_base = OTHER; note = Thymine phosphorothioate
  modified_base 65: mod_base = OTHER; note = Adenine phosphorothioate

SEQ ID NO: 962 - DNA, 70 bp, synthetic construct; identical to SEQ ID NO: 323
  source 1..70: mol_type = other DNA
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Cytosine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Guanosine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Guanosine phosphorothioate
  modified_base 64: mod_base = OTHER; note = Thymine phosphorothioate
  modified_base 65: mod_base = OTHER; note = Adenine phosphorothioate

SEQ ID NO: 963 - DNA, 70 bp, synthetic construct; identical to SEQ ID NO: 324
  source 1..70: mol_type = other DNA
  modified_base 50: mod_base = OTHER; note = Cytosine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Guanosine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Guanosine phosphorothioate
  modified_base 64: mod_base = OTHER; note = Thymine phosphorothioate
  modified_base 65: mod_base = OTHER; note = Adenine phosphorothioate

SEQ ID NO: 964 - DNA, 70 bp, synthetic construct; identical to SEQ ID NO: 325
  source 1..70: mol_type = other DNA
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Guanosine phosphorothioate
  modified_base 64: mod_base = OTHER; note = Thymine phosphorothioate
  modified_base 65: mod_base = OTHER; note = Adenine phosphorothioate

SEQ ID NO: 965 - DNA, 70 bp, synthetic construct; identical to SEQ ID NO: 326
  source 1..70: mol_type = other DNA
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Cytosine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Guanosine phosphorothioate
  modified_base 64: mod_base = OTHER; note = Thymine phosphorothioate
  modified_base 65: mod_base = OTHER; note = Adenine phosphorothioate

SEQ ID NO: 966 - DNA, 70 bp, synthetic construct; identical to SEQ ID NO: 327
  source 1..70: mol_type = other DNA
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Cytosine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Guanosine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Guanosine phosphorothioate
  modified_base 64: mod_base = OTHER; note = Thymine phosphorothioate
  modified_base 65: mod_base = OTHER; note = Adenine phosphorothioate

SEQ ID NO: 967 - DNA, 70 bp, synthetic construct; identical to SEQ ID NO: 328
  source 1..70: mol_type = other DNA
  modified_base 50: mod_base = OTHER; note = Cytosine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Guanosine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Guanosine phosphorothioate
  modified_base 64: mod_base = OTHER; note = Thymine phosphorothioate
  modified_base 65: mod_base = OTHER; note = Adenine phosphorothioate

SEQ ID NO: 968 - DNA, 70 bp, synthetic construct; identical to SEQ ID NO: 329
  source 1..70: mol_type = other DNA
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Guanosine phosphorothioate
  modified_base 62: mod_base = OTHER; note = Thymine phosphorothioate
  modified_base 63: mod_base = OTHER; note = Guanosine phosphorothioate
  modified_base 64: mod_base = OTHER; note = Thymine phosphorothioate
  modified_base 65: mod_base = OTHER; note = Adenine phosphorothioate

SEQ ID NO: 969 - DNA, 70 bp, synthetic construct; identical to SEQ ID NO: 330
  source 1..70: mol_type = other DNA
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Cytosine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Guanosine phosphorothioate
  modified_base 62: mod_base = OTHER; note = Thymine phosphorothioate
  modified_base 63: mod_base = OTHER; note = Guanosine phosphorothioate
  modified_base 64: mod_base = OTHER; note = Thymine phosphorothioate
  modified_base 65: mod_base = OTHER; note = Adenine phosphorothioate

SEQ ID NO: 970 - DNA, 70 bp, synthetic construct; identical to SEQ ID NO: 331
  source 1..70: mol_type = other DNA
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Cytosine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Guanosine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Guanosine phosphorothioate
  modified_base 62: mod_base = OTHER; note = Thymine phosphorothioate
  modified_base 63: mod_base = OTHER; note = Guanosine phosphorothioate
  modified_base 64: mod_base = OTHER; note = Thymine phosphorothioate
  modified_base 65: mod_base = OTHER; note = Adenine phosphorothioate

SEQ ID NO: 971 - DNA, 70 bp, synthetic construct; identical to SEQ ID NO: 332
  source 1..70: mol_type = other DNA
  modified_base 50: mod_base = OTHER; note = Cytosine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Guanosine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Guanosine phosphorothioate
  modified_base 62: mod_base = OTHER; note = Thymine phosphorothioate
  modified_base 63: mod_base = OTHER; note = Guanosine phosphorothioate
  modified_base 64: mod_base = OTHER; note = Thymine phosphorothioate
  modified_base 65: mod_base = OTHER; note = Adenine phosphorothioate

SEQ ID NO: 972 - DNA, 70 bp, synthetic construct; identical to SEQ ID NO: 333
  source 1..70: mol_type = other DNA
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Guanosine phosphorothioate
  modified_base 62: mod_base = OTHER; note = Thymine phosphorothioate
  modified_base 63: mod_base = OTHER; note = Adenine phosphorothioate
  modified_base 64: mod_base = OTHER; note = Thymine phosphorothioate
  modified_base 65: mod_base = OTHER; note = Adenine phosphorothioate

SEQ ID NO: 973 - DNA, 70 bp, synthetic construct; identical to SEQ ID NO: 334
  source 1..70: mol_type = other DNA
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Cytosine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Guanosine phosphorothioate
  modified_base 62: mod_base = OTHER; note = Thymine phosphorothioate
  modified_base 63: mod_base = OTHER; note = Adenine phosphorothioate
  modified_base 64: mod_base = OTHER; note = Thymine phosphorothioate
  modified_base 65: mod_base = OTHER; note = Adenine phosphorothioate

SEQ ID NO: 974 - DNA, 70 bp, synthetic construct; identical to SEQ ID NO: 335
  source 1..70: mol_type = other DNA
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Cytosine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Guanosine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Guanosine phosphorothioate
  modified_base 62: mod_base = OTHER; note = Thymine phosphorothioate
  modified_base 63: mod_base = OTHER; note = Adenine phosphorothioate
  modified_base 64: mod_base = OTHER; note = Thymine phosphorothioate
  modified_base 65: mod_base = OTHER; note = Adenine phosphorothioate

SEQ ID NO: 975 - DNA, 70 bp, synthetic construct; identical to SEQ ID NO: 336
  source 1..70: mol_type = other DNA
  modified_base 50: mod_base = OTHER; note = Cytosine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Guanosine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Guanosine phosphorothioate
  modified_base 62: mod_base = OTHER; note = Thymine phosphorothioate
  modified_base 63: mod_base = OTHER; note = Adenine phosphorothioate
  modified_base 64: mod_base = OTHER; note = Thymine phosphorothioate
  modified_base 65: mod_base = OTHER; note = Adenine phosphorothioate

SEQ ID NO: 976 - DNA, 68 bp, synthetic construct; identical to SEQ ID NO: 337
  source 1..68: mol_type = other DNA
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Guanosine phosphorothioate
  modified_base 62: mod_base = OTHER; note = Adenine phosphorothioate
  modified_base 63: mod_base = OTHER; note = Thymine phosphorothioate
  modified_base 64: mod_base = OTHER; note = Adenine phosphorothioate

SEQ ID NO: 977 - DNA, 68 bp, synthetic construct; identical to SEQ ID NO: 338
  source 1..68: mol_type = other DNA
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Cytosine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Guanosine phosphorothioate
  modified_base 62: mod_base = OTHER; note = Thymine phosphorothioate
  modified_base 63: mod_base = OTHER; note = Adenine phosphorothioate
  modified_base 64: mod_base = OTHER; note = Thymine phosphorothioate

SEQ ID NO: 978 - DNA, 68 bp, synthetic construct; identical to SEQ ID NO: 339
  source 1..68: mol_type = other DNA
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Cytosine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Guanosine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Cytosine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Guanosine phosphorothioate
  modified_base 62: mod_base = OTHER; note = Thymine phosphorothioate
  modified_base 63: mod_base = OTHER; note = Adenine phosphorothioate
  modified_base 64: mod_base = OTHER; note = Thymine phosphorothioate

SEQ ID NO: 979 - DNA, 68 bp, synthetic construct; identical to SEQ ID NO: 340
  source 1..68: mol_type = other DNA
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Guanosine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Cytosine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Guanosine phosphorothioate
  modified_base 62: mod_base = OTHER; note = Thymine phosphorothioate
  modified_base 63: mod_base = OTHER; note = Adenine phosphorothioate
  modified_base 64: mod_base = OTHER; note = Thymine phosphorothioate

SEQ ID NO: 980 - DNA, 68 bp, synthetic construct; identical to SEQ ID NO: 341
  source 1..68: mol_type = other DNA
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Guanosine phosphorothioate
  modified_base 62: mod_base = OTHER; note = Thymine phosphorothioate
  modified_base 63: mod_base = OTHER; note = Adenine phosphorothioate
  modified_base 64: mod_base = OTHER; note = Thymine phosphorothioate

SEQ ID NO: 981 - DNA, 68 bp, synthetic construct; identical to SEQ ID NO: 342
  source 1..68: mol_type = other DNA
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Cytosine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Guanosine phosphorothioate
  modified_base 62: mod_base = OTHER; note = Thymine phosphorothioate
  modified_base 63: mod_base = OTHER; note = Adenine phosphorothioate
  modified_base 64: mod_base = OTHER; note = Thymine phosphorothioate

SEQ ID NO: 982 - DNA, 68 bp, synthetic construct; identical to SEQ ID NO: 343
  source 1..68: mol_type = other DNA
  modified_base 49: mod_base = OTHER; note = Thymine phosphorothioate
  modified_base 50: mod_base = OTHER; note = Adenine phosphorothioate
  modified_base 51: mod_base = OTHER; note = Cytosine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Cytosine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Guanosine phosphorothioate
  modified_base 62: mod_base = OTHER; note = Thymine phosphorothioate
  modified_base 63: mod_base = OTHER; note = Adenine phosphorothioate
  modified_base 64: mod_base = OTHER; note = Thymine phosphorothioate

SEQ ID NO: 983 - DNA, 68 bp, synthetic construct; identical to SEQ ID NO: 344
  source 1..68: mol_type = other DNA
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Cytosine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Guanosine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Cytosine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Guanosine phosphorothioate
  modified_base 62: mod_base = OTHER; note = Thymine phosphorothioate
  modified_base 63: mod_base = OTHER; note = Adenine phosphorothioate
  modified_base 64: mod_base = OTHER; note = Thymine phosphorothioate

SEQ ID NO: 984 - DNA, 68 bp, synthetic construct; identical to SEQ ID NO: 345
  source 1..68: mol_type = other DNA
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Guanosine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Cytosine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Guanosine phosphorothioate
  modified_base 62: mod_base = OTHER; note = Thymine phosphorothioate
  modified_base 63: mod_base = OTHER; note = Adenine phosphorothioate
  modified_base 64: mod_base = OTHER; note = Thymine phosphorothioate

SEQ ID NO: 985 - DNA, 68 bp, synthetic construct; identical to SEQ ID NO: 346
  source 1..68: mol_type = other DNA
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Adenine phosphorothioate
  modified_base 64: mod_base = OTHER; note = Thymine phosphorothioate

SEQ ID NO: 986 - DNA, 68 bp, synthetic construct; identical to SEQ ID NO: 347
  source 1..68: mol_type = other DNA
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Cytosine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Guanosine phosphorothioate
  modified_base 62: mod_base = OTHER; note = Thymine phosphorothioate
  modified_base 63: mod_base = OTHER; note = Adenine phosphorothioate
  modified_base 64: mod_base = OTHER; note = Thymine phosphorothioate

SEQ ID NO: 987 - DNA, 68 bp, synthetic construct; identical to SEQ ID NO: 348
  source 1..68: mol_type = other DNA
  modified_base 49: mod_base = OTHER; note = Thymine phosphorothioate
  modified_base 50: mod_base = OTHER; note = Adenine phosphorothioate
  modified_base 51: mod_base = OTHER; note = Cytosine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Cytosine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Guanosine phosphorothioate
  modified_base 62: mod_base = OTHER; note = Thymine phosphorothioate
  modified_base 63: mod_base = OTHER; note = Adenine phosphorothioate
  modified_base 64: mod_base = OTHER; note = Thymine phosphorothioate

SEQ ID NO: 988 - DNA, 68 bp, synthetic construct; identical to SEQ ID NO: 349
  source 1..68: mol_type = other DNA
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Cytosine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Guanosine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Cytosine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Guanosine phosphorothioate
  modified_base 62: mod_base = OTHER; note = Thymine phosphorothioate
  modified_base 63: mod_base = OTHER; note = Adenine phosphorothioate
  modified_base 64: mod_base = OTHER; note = Thymine phosphorothioate

SEQ ID NO: 989 - DNA, 68 bp, synthetic construct; identical to SEQ ID NO: 350
  source 1..68: mol_type = other DNA
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Guanosine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Cytosine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Guanosine phosphorothioate
  modified_base 62: mod_base = OTHER; note = Thymine phosphorothioate
  modified_base 63: mod_base = OTHER; note = Adenine phosphorothioate
  modified_base 64: mod_base = OTHER; note = Thymine phosphorothioate

SEQ ID NO: 990 - DNA, 68 bp, synthetic construct; identical to SEQ ID NO: 351
  source 1..68: mol_type = other DNA
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Cytosine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Adenine phosphorothioate
  modified_base 64: mod_base = OTHER; note = Thymine phosphorothioate

SEQ ID NO: 991 - DNA, 68 bp, synthetic construct; identical to SEQ ID NO: 352
  source 1..68: mol_type = other DNA
  modified_base 49: mod_base = OTHER; note = Thymine phosphorothioate
  modified_base 50: mod_base = OTHER; note = Adenine phosphorothioate
  modified_base 51: mod_base = OTHER; note = Cytosine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Cytosine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Adenine phosphorothioate
  modified_base 64: mod_base = OTHER; note = Thymine phosphorothioate

SEQ ID NO: 992 - DNA, 68 bp, synthetic construct; identical to SEQ ID NO: 353
  source 1..68: mol_type = other DNA
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Cytosine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Guanosine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Cytosine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Adenine phosphorothioate
  modified_base 64: mod_base = OTHER; note = Thymine phosphorothioate

SEQ ID NO: 993 - DNA, 68 bp, synthetic construct; identical to SEQ ID NO: 354
  source 1..68: mol_type = other DNA
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Guanosine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Cytosine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Adenine phosphorothioate
  modified_base 64: mod_base = OTHER; note = Thymine phosphorothioate

SEQ ID NO: 994 - DNA, 66 bp, synthetic construct; identical to SEQ ID NO: 355
  source 1..66: mol_type = other DNA
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Cytosine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Adenine phosphorothioate

SEQ ID NO: 995 - DNA, 66 bp, synthetic construct; identical to SEQ ID NO: 356
  source 1..66: mol_type = other DNA
  modified_base 48: mod_base = OTHER; note = Thymine phosphorothioate
  modified_base 49: mod_base = OTHER; note = Adenine phosphorothioate
  modified_base 50: mod_base = OTHER; note = Cytosine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Guanosine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Cytosine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Adenine phosphorothioate

SEQ ID NO: 996 - DNA, 66 bp, synthetic construct; identical to SEQ ID NO: 357
  source 1..66: mol_type = other DNA
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Guanosine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Cytosine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Adenine phosphorothioate

SEQ ID NO: 997 - DNA, 66 bp, synthetic construct; identical to SEQ ID NO: 358
  source 1..66: mol_type = other DNA
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Cytosine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Adenine phosphorothioate

SEQ ID NO: 998 - DNA, 66 bp, synthetic construct; identical to SEQ ID NO: 359
  source 1..66: mol_type = other DNA
  modified_base 48: mod_base = OTHER; note = Adenine phosphorothioate
  modified_base 49: mod_base = OTHER; note = Cytosine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Cytosine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Adenine phosphorothioate

SEQ ID NO: 999 - DNA, 66 bp, synthetic construct; identical to SEQ ID NO: 360
  source 1..66: mol_type = other DNA
  modified_base 48: mod_base = OTHER; note = Thymine phosphorothioate
  modified_base 49: mod_base = OTHER; note = Adenine phosphorothioate
  modified_base 50: mod_base = OTHER; note = Cytosine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Guanosine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Cytosine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Adenine phosphorothioate

SEQ ID NO: 1000 - DNA, 66 bp, synthetic construct; identical to SEQ ID NO: 361
  source 1..66: mol_type = other DNA
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Guanosine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Cytosine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Adenine phosphorothioate

SEQ ID NO: 1001 - DNA, 66 bp, synthetic construct; identical to SEQ ID NO: 362
  source 1..66: mol_type = other DNA
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Cytosine phosphorothioate
  modified_base 57: mod_base = OTHER; note = Guanosine phosphorothioate
  modified_base 58: mod_base = OTHER; note = Thymine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Adenine phosphorothioate

SEQ ID NO: 1002 - DNA, 66 bp, synthetic construct; identical to SEQ ID NO: 363
  source 1..66: mol_type = other DNA
  modified_base 48: mod_base = OTHER; note = Adenine phosphorothioate
  modified_base 49: mod_base = OTHER; note = Cytosine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Cytosine phosphorothioate
  modified_base 57: mod_base = OTHER; note = Guanosine phosphorothioate
  modified_base 58: mod_base = OTHER; note = Thymine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Adenine phosphorothioate

SEQ ID NO: 1003 - DNA, 66 bp, synthetic construct; identical to SEQ ID NO: 364
  source 1..66: mol_type = other DNA
  modified_base 48: mod_base = OTHER; note = Thymine phosphorothioate
  modified_base 49: mod_base = OTHER; note = Adenine phosphorothioate
  modified_base 50: mod_base = OTHER; note = Cytosine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Guanosine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Cytosine phosphorothioate
  modified_base 57: mod_base = OTHER; note = Guanosine phosphorothioate
  modified_base 58: mod_base = OTHER; note = Thymine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Adenine phosphorothioate

SEQ ID NO: 1004 - DNA, 66 bp, synthetic construct; identical to SEQ ID NO: 365
  source 1..66: mol_type = other DNA
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Guanosine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Cytosine phosphorothioate
  modified_base 57: mod_base = OTHER; note = Guanosine phosphorothioate
  modified_base 58: mod_base = OTHER; note = Thymine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Adenine phosphorothioate

SEQ ID NO: 1005 - DNA, 66 bp, synthetic construct; identical to SEQ ID NO: 366
  source 1..66: mol_type = other DNA
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Cytosine phosphorothioate
  modified_base 57: mod_base = OTHER; note = Guanosine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Adenine phosphorothioate

SEQ ID NO: 1006 - DNA, 66 bp, synthetic construct; identical to SEQ ID NO: 367
  source 1..66: mol_type = other DNA
  modified_base 48: mod_base = OTHER; note = Adenine phosphorothioate
  modified_base 49: mod_base = OTHER; note = Cytosine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Cytosine phosphorothioate
  modified_base 57: mod_base = OTHER; note = Guanosine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Adenine phosphorothioate

SEQ ID NO: 1007 - DNA, 66 bp, synthetic construct; identical to SEQ ID NO: 368
  source 1..66: mol_type = other DNA
  modified_base 48: mod_base = OTHER; note = Thymine phosphorothioate
  modified_base 49: mod_base = OTHER; note = Adenine phosphorothioate
  modified_base 50: mod_base = OTHER; note = Cytosine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Guanosine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Cytosine phosphorothioate
  modified_base 57: mod_base = OTHER; note = Guanosine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Adenine phosphorothioate

SEQ ID NO: 1008 - DNA, 66 bp, synthetic construct; identical to SEQ ID NO: 369
  source 1..66: mol_type = other DNA
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Guanosine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Cytosine phosphorothioate
  modified_base 57: mod_base = OTHER; note = Guanosine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Adenine phosphorothioate

SEQ ID NO: 1009 - DNA, 64 bp, synthetic construct; identical to SEQ ID NO: 370
  source 1..64: mol_type = other DNA
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Cytosine phosphorothioate
  modified_base 54: mod_base = OTHER; note = Adenine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Guanosine phosphorothioate
  modified_base 62: mod_base = OTHER; note = Thymine phosphorothioate

SEQ ID NO: 1010 - DNA, 64 bp, synthetic construct; identical to SEQ ID NO: 371
  source 1..64: mol_type = other DNA
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Cytosine phosphorothioate
  modified_base 54: mod_base = OTHER; note = Adenine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Guanosine phosphorothioate
  modified_base 62: mod_base = OTHER; note = Thymine phosphorothioate

SEQ ID NO: 1011 - DNA, 64 bp, synthetic construct; identical to SEQ ID NO: 372
  source 1..64: mol_type = other DNA
  modified_base 47: mod_base = OTHER; note = Cytosine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Guanosine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Cytosine phosphorothioate
  modified_base 54: mod_base = OTHER; note = Adenine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Guanosine phosphorothioate
  modified_base 62: mod_base = OTHER; note = Thymine phosphorothioate

SEQ ID NO: 1012 - DNA, 64 bp, synthetic construct; identical to SEQ ID NO: 373
  source 1..64: mol_type = other DNA
  modified_base 47: mod_base = OTHER; note = Thymine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Guanosine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Cytosine phosphorothioate
  modified_base 54: mod_base = OTHER; note = Adenine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Guanosine phosphorothioate
  modified_base 62: mod_base = OTHER; note = Thymine phosphorothioate

SEQ ID NO: 1013 - DNA, 64 bp, synthetic construct; identical to SEQ ID NO: 374
  source 1..64: mol_type = other DNA
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Cytosine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Guanosine phosphorothioate
  modified_base 61: mod_base = OTHER; note = Thymine phosphorothioate
  modified_base 62: mod_base = OTHER; note = Adenine phosphorothioate

SEQ ID NO: 1014 - DNA, 64 bp, synthetic construct; identical to SEQ ID NO: 375
  source 1..64: mol_type = other DNA
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Cytosine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Guanosine phosphorothioate
  modified_base 61: mod_base = OTHER; note = Thymine phosphorothioate
  modified_base 62: mod_base = OTHER; note = Adenine phosphorothioate

SEQ ID NO: 1015 - DNA, 64 bp, synthetic construct; identical to SEQ ID NO: 376
  source 1..64: mol_type = other DNA
  modified_base 47: mod_base = OTHER; note = Cytosine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Guanosine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Cytosine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Guanosine phosphorothioate
  modified_base 61: mod_base = OTHER; note = Thymine phosphorothioate
  modified_base 62: mod_base = OTHER; note = Adenine phosphorothioate

SEQ ID NO: 1016 - DNA, 64 bp, synthetic construct; identical to SEQ ID NO: 377
  source 1..64: mol_type = other DNA
  modified_base 47: mod_base = OTHER; note = Thymine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Guanosine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Cytosine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Guanosine phosphorothioate
  modified_base 61: mod_base = OTHER; note = Thymine phosphorothioate
  modified_base 62: mod_base = OTHER; note = Adenine phosphorothioate

SEQ ID NO: 1017 - DNA, 66 bp, synthetic construct; identical to SEQ ID NO: 378
  source 1..66: mol_type = other DNA
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Cytosine phosphorothioate
  modified_base 55: mod_base = OTHER; note = Adenine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Thymine phosphorothioate
  modified_base 62: mod_base = OTHER; note = Guanosine phosphorothioate
  modified_base 63: mod_base = OTHER; note = Adenine phosphorothioate

SEQ ID NO: 1018 - DNA, 66 bp, synthetic construct; identical to SEQ ID NO: 379
  source 1..66: mol_type = other DNA
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Cytosine phosphorothioate
  modified_base 55: mod_base = OTHER; note = Adenine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Thymine phosphorothioate
  modified_base 62: mod_base = OTHER; note = Guanosine phosphorothioate
  modified_base 63: mod_base = OTHER; note = Adenine phosphorothioate

SEQ ID NO: 1019 - DNA, 66 bp, synthetic construct; identical to SEQ ID NO: 380
  source 1..66: mol_type = other DNA
  modified_base 48: mod_base = OTHER; note = Cytosine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Guanosine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Cytosine phosphorothioate
  modified_base 55: mod_base = OTHER; note = Adenine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Thymine phosphorothioate
  modified_base 62: mod_base = OTHER; note = Guanosine phosphorothioate
  modified_base 63: mod_base = OTHER; note = Adenine phosphorothioate

SEQ ID NO: 1020 - DNA, 66 bp, synthetic construct; identical to SEQ ID NO: 381
  source 1..66: mol_type = other DNA
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Guanosine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Cytosine phosphorothioate
  modified_base 55: mod_base = OTHER; note = Adenine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Thymine phosphorothioate
  modified_base 62: mod_base = OTHER; note = Guanosine phosphorothioate
  modified_base 63: mod_base = OTHER; note = Adenine phosphorothioate

SEQ ID NO: 1021 - DNA, 68 bp, synthetic construct; identical to SEQ ID NO: 382
  source 1..68: mol_type = other DNA
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Cytosine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Guanosine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Guanosine phosphorothioate
  modified_base 62: mod_base = OTHER; note = Thymine phosphorothioate
  modified_base 63: mod_base = OTHER; note = Adenine phosphorothioate
  modified_base 64: mod_base = OTHER; note = Thymine phosphorothioate

SEQ ID NO: 1022 - DNA, 68 bp, synthetic construct; identical to SEQ ID NO: 383
  source 1..68: mol_type = other DNA
  modified_base 49: mod_base = OTHER; note = Adenine phosphorothioate
  modified_base 50: mod_base = OTHER; note = Cytosine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Guanosine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Guanosine phosphorothioate
  modified_base 62: mod_base = OTHER; note = Thymine phosphorothioate
  modified_base 63: mod_base = OTHER; note = Adenine phosphorothioate
  modified_base 64: mod_base = OTHER; note = Thymine phosphorothioate

SEQ ID NO: 1023 - DNA, 68 bp, synthetic construct; identical to SEQ ID NO: 384
  source 1..68: mol_type = other DNA
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Cytosine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Guanosine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Guanosine phosphorothioate
  modified_base 62: mod_base = OTHER; note = Thymine phosphorothioate
  modified_base 63: mod_base = OTHER; note = Adenine phosphorothioate
  modified_base 64: mod_base = OTHER; note = Thymine phosphorothioate

SEQ ID NO: 1024 - DNA, 68 bp, synthetic construct; identical to SEQ ID NO: 385
  source 1..68: mol_type = other DNA
  modified_base 49: mod_base = OTHER; note = Adenine phosphorothioate
  modified_base 50: mod_base = OTHER; note = Cytosine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Guanosine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Guanosine phosphorothioate
  modified_base 62: mod_base = OTHER; note = Thymine phosphorothioate
  modified_base 63: mod_base = OTHER; note = Adenine phosphorothioate
  modified_base 64: mod_base = OTHER; note = Thymine phosphorothioate

SEQ ID NO: 1025 - DNA, 68 bp, synthetic construct; identical to SEQ ID NO: 386
  source 1..68: mol_type = other DNA
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Cytosine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Guanosine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Guanosine phosphorothioate
  modified_base 62: mod_base = OTHER; note = Thymine phosphorothioate
  modified_base 63: mod_base = OTHER; note = Adenine phosphorothioate
  modified_base 64: mod_base = OTHER; note = Thymine phosphorothioate

SEQ ID NO: 1026 - DNA, 68 bp, synthetic construct; identical to SEQ ID NO: 387
  source 1..68: mol_type = other DNA
  modified_base 49: mod_base = OTHER; note = Adenine phosphorothioate
  modified_base 50: mod_base = OTHER; note = Cytosine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Guanosine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Guanosine phosphorothioate
  modified_base 62: mod_base = OTHER; note = Thymine phosphorothioate
  modified_base 63: mod_base = OTHER; note = Adenine phosphorothioate
  modified_base 64: mod_base = OTHER; note = Thymine phosphorothioate

SEQ ID NO: 1027 - DNA, 68 bp, synthetic construct; identical to SEQ ID NO: 388
  source 1..68: mol_type = other DNA
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Cytosine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Guanosine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Guanosine phosphorothioate
  modified_base 62: mod_base = OTHER; note = Guanosine phosphorothioate
  modified_base 63: mod_base = OTHER; note = Adenine phosphorothioate
  modified_base 64: mod_base = OTHER; note = Thymine phosphorothioate

SEQ ID NO: 1028 - DNA, 68 bp, synthetic construct; identical to SEQ ID NO: 389
  source 1..68: mol_type = other DNA
  modified_base 49: mod_base = OTHER; note = Adenine phosphorothioate
  modified_base 50: mod_base = OTHER; note = Cytosine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Guanosine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Guanosine phosphorothioate
  modified_base 62: mod_base = OTHER; note = Guanosine phosphorothioate
  modified_base 63: mod_base = OTHER; note = Adenine phosphorothioate
  modified_base 64: mod_base = OTHER; note = Thymine phosphorothioate

SEQ ID NO: 1029 - DNA, 72 bp, synthetic construct; identical to SEQ ID NO: 390
  source 1..72: mol_type = other DNA
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Adenine phosphorothioate
  modified_base 56: mod_base = OTHER; note = Cytosine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Guanosine phosphorothioate
  modified_base 60: mod_base = OTHER; note = Adenine phosphorothioate
  modified_base 61: mod_base = OTHER; note = Thymine phosphorothioate
  modified_base 62: mod_base = OTHER; note = Cytosine phosphorothioate
  modified_base 63: mod_base = OTHER; note = Adenine phosphorothioate
  modified_base 64: mod_base = OTHER; note = Thymine phosphorothioate
  modified_base 65: mod_base = OTHER; note = Guanosine phosphorothioate
  modified_base 66: mod_base = OTHER; note = Thymine phosphorothioate

SEQ ID NO: 1030 - DNA, 72 bp, synthetic construct; identical to SEQ ID NO: 391
  source 1..72: mol_type = other DNA
  modified_base 51: mod_base = OTHER; note = Adenine phosphorothioate
  modified_base 52: mod_base = OTHER; note = Cytosine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Guanosine phosphorothioate
  modified_base 60: mod_base = OTHER; note = Adenine phosphorothioate
  modified_base 61: mod_base = OTHER; note = Thymine phosphorothioate
  modified_base 62: mod_base = OTHER; note = Cytosine phosphorothioate
  modified_base 63: mod_base = OTHER; note = Adenine phosphorothioate
  modified_base 64: mod_base = OTHER; note = Thymine phosphorothioate
  modified_base 65: mod_base = OTHER; note = Guanosine phosphorothioate
  modified_base 66: mod_base = OTHER; note = Thymine phosphorothioate

SEQ ID NO: 1031 - DNA, 72 bp, synthetic construct; identical to SEQ ID NO: 392
  source 1..72: mol_type = other DNA
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Cytosine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Thymine phosphorothioate
  modified_base 62: mod_base = OTHER; note = Cytosine phosphorothioate
  modified_base 63: mod_base = OTHER; note = Adenine phosphorothioate
  modified_base 64: mod_base = OTHER; note = Thymine phosphorothioate
  modified_base 65: mod_base = OTHER; note = Guanosine phosphorothioate
  modified_base 66: mod_base = OTHER; note = Thymine phosphorothioate

SEQ ID NO: 1032 - DNA, 72 bp, synthetic construct; identical to SEQ ID NO: 393
  source 1..72: mol_type = other DNA
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Adenine phosphorothioate
  modified_base 56: mod_base = OTHER; note = Cytosine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Guanosine phosphorothioate
  modified_base 60: mod_base = OTHER; note = Adenine phosphorothioate
  modified_base 61: mod_base = OTHER; note = Thymine phosphorothioate
  modified_base 62: mod_base = OTHER; note = Cytosine phosphorothioate
  modified_base 63: mod_base = OTHER; note = Adenine phosphorothioate
  modified_base 64: mod_base = OTHER; note = Thymine phosphorothioate
  modified_base 65: mod_base = OTHER; note = Guanosine phosphorothioate
  modified_base 66: mod_base = OTHER; note = Thymine phosphorothioate

SEQ ID NO: 1033 - DNA, 72 bp, synthetic construct; identical to SEQ ID NO: 394
  source 1..72: mol_type = other DNA
  modified_base 51: mod_base = OTHER; note = Adenine phosphorothioate
  modified_base 52: mod_base = OTHER; note = Cytosine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Guanosine phosphorothioate
  modified_base 60: mod_base = OTHER; note = Adenine phosphorothioate
  modified_base 61: mod_base = OTHER; note = Thymine phosphorothioate
  modified_base 62: mod_base = OTHER; note = Cytosine phosphorothioate
  modified_base 63: mod_base = OTHER; note = Adenine phosphorothioate
  modified_base 64: mod_base = OTHER; note = Thymine phosphorothioate
  modified_base 65: mod_base = OTHER; note = Guanosine phosphorothioate
  modified_base 66: mod_base = OTHER; note = Thymine phosphorothioate

SEQ ID NO: 1034 - DNA, 72 bp, synthetic construct; identical to SEQ ID NO: 395
  source 1..72: mol_type = other DNA
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Adenine phosphorothioate
  modified_base 56: mod_base = OTHER; note = Cytosine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Guanosine phosphorothioate
  modified_base 60: mod_base = OTHER; note = Adenine phosphorothioate
  modified_base 61: mod_base = OTHER; note = Thymine phosphorothioate
  modified_base 62: mod_base = OTHER; note = Cytosine phosphorothioate
  modified_base 63: mod_base = OTHER; note = Guanosine phosphorothioate
  modified_base 64: mod_base = OTHER; note = Thymine phosphorothioate
  modified_base 65: mod_base = OTHER; note = Guanosine phosphorothioate
  modified_base 66: mod_base = OTHER; note = Thymine phosphorothioate

SEQ ID NO: 1035 - DNA, 72 bp, synthetic construct; identical to SEQ ID NO: 396
  source 1..72: mol_type = other DNA
  modified_base 51: mod_base = OTHER; note = Adenine phosphorothioate
  modified_base 52: mod_base = OTHER; note = Cytosine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Guanosine phosphorothioate
  modified_base 60: mod_base = OTHER; note = Adenine phosphorothioate
  modified_base 61: mod_base = OTHER; note = Thymine phosphorothioate
  modified_base 62: mod_base = OTHER; note = Cytosine phosphorothioate
  modified_base 63: mod_base = OTHER; note = Guanosine phosphorothioate
  modified_base 64: mod_base = OTHER; note = Thymine phosphorothioate
  modified_base 65: mod_base = OTHER; note = Guanosine phosphorothioate
  modified_base 66: mod_base = OTHER; note = Thymine phosphorothioate

SEQ ID NO: 1036 - DNA, 72 bp, synthetic construct; identical to SEQ ID NO: 397
  source 1..72: mol_type = other DNA
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Adenine phosphorothioate
  modified_base 56: mod_base = OTHER; note = Cytosine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Guanosine phosphorothioate
  modified_base 60: mod_base = OTHER; note = Adenine phosphorothioate
  modified_base 61: mod_base = OTHER; note = Thymine phosphorothioate
  modified_base 62: mod_base = OTHER; note = Cytosine phosphorothioate
  modified_base 63: mod_base = OTHER; note = Guanosine phosphorothioate
  modified_base 64: mod_base = OTHER; note = Thymine phosphorothioate
  modified_base 65: mod_base = OTHER; note = Adenine phosphorothioate
  modified_base 66: mod_base = OTHER; note = Thymine phosphorothioate

SEQ ID NO: 1037 - DNA, 72 bp, synthetic construct; identical to SEQ ID NO: 398
  source 1..72: mol_type = other DNA
  modified_base 51: mod_base = OTHER; note = Adenine phosphorothioate
  modified_base 52: mod_base = OTHER; note = Cytosine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Guanosine phosphorothioate
  modified_base 60: mod_base = OTHER; note = Adenine phosphorothioate
  modified_base 61: mod_base = OTHER; note = Thymine phosphorothioate
  modified_base 62: mod_base = OTHER; note = Cytosine phosphorothioate
  modified_base 63: mod_base = OTHER; note = Guanosine phosphorothioate
  modified_base 64: mod_base = OTHER; note = Thymine phosphorothioate
  modified_base 65: mod_base = OTHER; note = Adenine phosphorothioate
  modified_base 66: mod_base = OTHER; note = Thymine phosphorothioate

SEQ ID NO: 1038 - DNA, 66 bp, synthetic construct; identical to SEQ ID NO: 399
  source 1..66: mol_type = other DNA
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Cytosine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Guanosine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Cytosine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Adenine phosphorothioate

SEQ ID NO: 1039 - DNA, 66 bp, synthetic construct; identical to SEQ ID NO: 400
  source 1..66: mol_type = other DNA
  modified_base 48: mod_base = OTHER; note = Cytosine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Guanosine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Cytosine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Adenine phosphorothioate

SEQ ID NO: 1040 - DNA, 66 bp, synthetic construct; identical to SEQ ID NO: 401
  source 1..66: mol_type = other DNA
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Cytosine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Guanosine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Cytosine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Adenine phosphorothioate

SEQ ID NO: 1041 - DNA, 66 bp, synthetic construct; identical to SEQ ID NO: 402
  source 1..66: mol_type = other DNA
  modified_base 48: mod_base = OTHER; note = Cytosine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Guanosine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Cytosine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Adenine phosphorothioate

SEQ ID NO: 1042 - DNA, 66 bp, synthetic construct; identical to SEQ ID NO: 403
  source 1..66: mol_type = other DNA
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Cytosine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Guanosine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Cytosine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Cytosine phosphorothioate

SEQ ID NO: 1043 - DNA, 66 bp, synthetic construct; identical to SEQ ID NO: 404
  source 1..66: mol_type = other DNA
  modified_base 48: mod_base = OTHER; note = Cytosine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Guanosine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Cytosine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Cytosine phosphorothioate

SEQ ID NO: 1044 - DNA, 66 bp, synthetic construct; identical to SEQ ID NO: 405
  source 1..66: mol_type = other DNA
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Cytosine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Guanosine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Cytosine phosphorothioate
  modified_base 59: mod_base = OTHER; note = Guanosine phosphorothioate
  modified_base 60: mod_base = OTHER; note = Guanosine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Cytosine phosphorothioate

SEQ ID NO: 1045 - DNA, 66 bp, synthetic construct; identical to SEQ ID NO: 406
  source 1..66: mol_type = other DNA
  modified_base 48: mod_base = OTHER; note = Cytosine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Guanosine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Cytosine phosphorothioate
  modified_base 59: mod_base = OTHER; note = Guanosine phosphorothioate
  modified_base 60: mod_base = OTHER; note = Guanosine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Cytosine phosphorothioate

SEQ ID NO: 1046 - DNA, 70 bp, synthetic construct; identical to SEQ ID NO: 407
  source 1..70: mol_type = other DNA
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Cytosine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Guanosine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Guanosine phosphorothioate
  modified_base 64: mod_base = OTHER; note = Thymine phosphorothioate
  modified_base 65: mod_base = OTHER; note = Adenine phosphorothioate

SEQ ID NO: 1047 - DNA, 70 bp, synthetic construct; identical to SEQ ID NO: 408
  source 1..70: mol_type = other DNA
  modified_base 50: mod_base = OTHER; note = Cytosine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Guanosine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Guanosine phosphorothioate
  modified_base 64: mod_base = OTHER; note = Thymine phosphorothioate
  modified_base 65: mod_base = OTHER; note = Adenine phosphorothioate

SEQ ID NO: 1048 - DNA, 70 bp, synthetic construct; identical to SEQ ID NO: 409
  source 1..70: mol_type = other DNA
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Cytosine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Guanosine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Guanosine phosphorothioate
  modified_base 64: mod_base = OTHER; note = Thymine phosphorothioate
  modified_base 65: mod_base = OTHER; note = Adenine phosphorothioate

SEQ ID NO: 1049 - DNA, 70 bp, synthetic construct; identical to SEQ ID NO: 410
  source 1..70: mol_type = other DNA
  modified_base 50: mod_base = OTHER; note = Cytosine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Guanosine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Guanosine phosphorothioate
  modified_base 64: mod_base = OTHER; note = Thymine phosphorothioate
  modified_base 65: mod_base = OTHER; note = Adenine phosphorothioate

SEQ ID NO: 1050 - DNA, 70 bp, synthetic construct; identical to SEQ ID NO: 411
  source 1..70: mol_type = other DNA
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Cytosine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Guanosine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Guanosine phosphorothioate
  modified_base 62: mod_base = OTHER; note = Thymine phosphorothioate
  modified_base 63: mod_base = OTHER; note = Guanosine phosphorothioate
  modified_base 64: mod_base = OTHER; note = Thymine phosphorothioate
  modified_base 65: mod_base = OTHER; note = Adenine phosphorothioate

SEQ ID NO: 1051 - DNA, 70 bp, synthetic construct; identical to SEQ ID NO: 412
  source 1..70: mol_type = other DNA
  modified_base 50: mod_base = OTHER; note = Cytosine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Guanosine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Guanosine phosphorothioate
  modified_base 62: mod_base = OTHER; note = Thymine phosphorothioate
  modified_base 63: mod_base = OTHER; note = Guanosine phosphorothioate
  modified_base 64: mod_base = OTHER; note = Thymine phosphorothioate
  modified_base 65: mod_base = OTHER; note = Adenine phosphorothioate

SEQ ID NO: 1052 - DNA, 70 bp, synthetic construct; identical to SEQ ID NO: 413
  source 1..70: mol_type = other DNA
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Cytosine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Guanosine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Guanosine phosphorothioate
  modified_base 62: mod_base = OTHER; note = Thymine phosphorothioate
  modified_base 63: mod_base = OTHER; note = Adenine phosphorothioate
  modified_base 64: mod_base = OTHER; note = Thymine phosphorothioate
  modified_base 65: mod_base = OTHER; note = Adenine phosphorothioate

SEQ ID NO: 1053 - DNA, 70 bp, synthetic construct; identical to SEQ ID NO: 414
  source 1..70: mol_type = other DNA
  modified_base 50: mod_base = OTHER; note = Cytosine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Guanosine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Guanosine phosphorothioate
  modified_base 62: mod_base = OTHER; note = Thymine phosphorothioate
  modified_base 63: mod_base = OTHER; note = Adenine phosphorothioate
  modified_base 64: mod_base = OTHER; note = Thymine phosphorothioate
  modified_base 65: mod_base = OTHER; note = Adenine phosphorothioate

SEQ ID NO: 1054 - DNA, 68 bp, synthetic construct; identical to SEQ ID NO: 415
  source 1..68: mol_type = other DNA
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Guanosine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Cytosine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Guanosine phosphorothioate
  modified_base 62: mod_base = OTHER; note = Thymine phosphorothioate
  modified_base 63: mod_base = OTHER; note = Adenine phosphorothioate
  modified_base 64: mod_base = OTHER; note = Thymine phosphorothioate

SEQ ID NO: 1055 - DNA, 68 bp, synthetic construct; identical to SEQ ID NO: 416
  source 1..68: mol_type = other DNA
  modified_base 49: mod_base = OTHER; note = Thymine phosphorothioate
  modified_base 50: mod_base = OTHER; note = Adenine phosphorothioate
  modified_base 51: mod_base = OTHER; note = Cytosine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Cytosine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Guanosine phosphorothioate
  modified_base 62: mod_base = OTHER; note = Thymine phosphorothioate
  modified_base 63: mod_base = OTHER; note = Adenine phosphorothioate
  modified_base 64: mod_base = OTHER; note = Thymine phosphorothioate

SEQ ID NO: 1056 - DNA, 68 bp, synthetic construct; identical to SEQ ID NO: 417
  source 1..68: mol_type = other DNA
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Guanosine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Cytosine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Guanosine phosphorothioate
  modified_base 62: mod_base = OTHER; note = Thymine phosphorothioate
  modified_base 63: mod_base = OTHER; note = Adenine phosphorothioate
  modified_base 64: mod_base = OTHER; note = Thymine phosphorothioate

SEQ ID NO: 1057 - DNA, 68 bp, synthetic construct; identical to SEQ ID NO: 418
  source 1..68: mol_type = other DNA
  modified_base 49: mod_base = OTHER; note = Thymine phosphorothioate
  modified_base 50: mod_base = OTHER; note = Adenine phosphorothioate
  modified_base 51: mod_base = OTHER; note = Cytosine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Cytosine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Guanosine phosphorothioate
  modified_base 62: mod_base = OTHER; note = Thymine phosphorothioate
  modified_base 63: mod_base = OTHER; note = Adenine phosphorothioate
  modified_base 64: mod_base = OTHER; note = Thymine phosphorothioate

SEQ ID NO: 1058 - DNA, 68 bp, synthetic construct; identical to SEQ ID NO: 419
  source 1..68: mol_type = other DNA
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Guanosine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Cytosine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Guanosine phosphorothioate
  modified_base 62: mod_base = OTHER; note = Thymine phosphorothioate
  modified_base 63: mod_base = OTHER; note = Adenine phosphorothioate
  modified_base 64: mod_base = OTHER; note = Thymine phosphorothioate

SEQ ID NO: 1059 - DNA, 68 bp, synthetic construct; identical to SEQ ID NO: 420
  source 1..68: mol_type = other DNA
  modified_base 49: mod_base = OTHER; note = Thymine phosphorothioate
  modified_base 50: mod_base = OTHER; note = Adenine phosphorothioate
  modified_base 51: mod_base = OTHER; note = Cytosine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Cytosine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Adenine phosphorothioate
  modified_base 64: mod_base = OTHER; note = Thymine phosphorothioate

SEQ ID NO: 1060 - DNA, 68 bp, synthetic construct; identical to SEQ ID NO: 421
  source 1..68: mol_type = other DNA
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Guanosine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Cytosine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Adenine phosphorothioate
  modified_base 64: mod_base = OTHER; note = Thymine phosphorothioate

SEQ ID NO: 1061 - DNA, 66 bp, synthetic construct; identical to SEQ ID NO: 422
  source 1..66: mol_type = other DNA
  modified_base 48: mod_base = OTHER; note = Thymine phosphorothioate
  modified_base 49: mod_base = OTHER; note = Adenine phosphorothioate
  modified_base 50: mod_base = OTHER; note = Cytosine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Guanosine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Cytosine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Adenine phosphorothioate

SEQ ID NO: 1062 - DNA, 66 bp, synthetic construct; identical to SEQ ID NO: 423
  source 1..66: mol_type = other DNA
  modified_base 48: mod_base = OTHER; note = Adenine phosphorothioate
  modified_base 49: mod_base = OTHER; note = Cytosine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Cytosine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Adenine phosphorothioate

SEQ ID NO: 1063 - DNA, 66 bp, synthetic construct; identical to SEQ ID NO: 424
  source 1..66: mol_type = other DNA
  modified_base 48: mod_base = OTHER; note = Thymine phosphorothioate
  modified_base 49: mod_base = OTHER; note = Adenine phosphorothioate
  modified_base 50: mod_base = OTHER; note = Cytosine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Guanosine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Cytosine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Adenine phosphorothioate

SEQ ID NO: 1064 - DNA, 66 bp, synthetic construct; identical to SEQ ID NO: 425
  source 1..66: mol_type = other DNA
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Guanosine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Cytosine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Adenine phosphorothioate

SEQ ID NO: 1065 - DNA, 66 bp, synthetic construct; identical to SEQ ID NO: 426
  source 1..66: mol_type = other DNA
  modified_base 48: mod_base = OTHER; note = Thymine phosphorothioate
  modified_base 49: mod_base = OTHER; note = Adenine phosphorothioate
  modified_base 50: mod_base = OTHER; note = Cytosine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Guanosine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Cytosine phosphorothioate
  modified_base 57: mod_base = OTHER; note = Guanosine phosphorothioate
  modified_base 58: mod_base = OTHER; note = Thymine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Adenine phosphorothioate

SEQ ID NO: 1066 - DNA, 66 bp, synthetic construct; identical to SEQ ID NO: 427
  source 1..66: mol_type = other DNA
  modified_base 48: mod_base = OTHER; note = Thymine phosphorothioate
  modified_base 49: mod_base = OTHER; note = Adenine phosphorothioate
  modified_base 50: mod_base = OTHER; note = Cytosine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Guanosine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Cytosine phosphorothioate
  modified_base 57: mod_base = OTHER; note = Guanosine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Adenine phosphorothioate

SEQ ID NO: 1067 - DNA, 62 bp, synthetic construct; identical to SEQ ID NO: 428
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Cytosine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Guanosine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Cytosine phosphorothioate
  modified_base 58: mod_base = OTHER; note = Guanosine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Thymine phosphorothioate

SEQ ID NO: 1068 - DNA, 62 bp, synthetic construct; identical to SEQ ID NO: 429
  source 1..62: mol_type = other DNA
  modified_base 46: mod_base = OTHER; note = Adenine phosphorothioate
  modified_base 47: mod_base = OTHER; note = Cytosine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Guanosine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Cytosine phosphorothioate
  modified_base 58: mod_base = OTHER; note = Guanosine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Thymine phosphorothioate

SEQ ID NO: 1069 - DNA, 62 bp, synthetic construct; identical to SEQ ID NO: 430
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Cytosine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Guanosine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Cytosine phosphorothioate
  modified_base 58: mod_base = OTHER; note = Guanosine phosphorothioate
  modified_base 59: mod_base = OTHER; note = Thymine phosphorothioate
  modified_base 60: mod_base = OTHER; note = Guanosine phosphorothioate
  modified_base 61: mod_base = OTHER; note = Thymine phosphorothioate

SEQ ID NO: 1070 - DNA, 62 bp, synthetic construct; identical to SEQ ID NO: 431
  source 1..62: mol_type = other DNA
  modified_base 46: mod_base = OTHER; note = Adenine phosphorothioate
  modified_base 47: mod_base = OTHER; note = Cytosine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Guanosine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Cytosine phosphorothioate
  modified_base 58: mod_base = OTHER; note = Guanosine phosphorothioate
  modified_base 59: mod_base = OTHER; note = Thymine phosphorothioate
  modified_base 60: mod_base = OTHER; note = Guanosine phosphorothioate
  modified_base 61: mod_base = OTHER; note = Thymine phosphorothioate

SEQ ID NO: 1071 - DNA, 62 bp, synthetic construct; identical to SEQ ID NO: 432
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Cytosine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Guanosine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Cytosine phosphorothioate
  modified_base 58: mod_base = OTHER; note = Guanosine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Cytosine phosphorothioate

SEQ ID NO: 1072 - DNA, 62 bp, synthetic construct; identical to SEQ ID NO: 433
  source 1..62: mol_type = other DNA
  modified_base 46: mod_base = OTHER; note = Adenine phosphorothioate
  modified_base 47: mod_base = OTHER; note = Cytosine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Guanosine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Cytosine phosphorothioate
  modified_base 58: mod_base = OTHER; note = Guanosine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Cytosine phosphorothioate

SEQ ID NO: 1073 - DNA, 62 bp, synthetic construct; identical to SEQ ID NO: 434
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Cytosine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Guanosine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Cytosine phosphorothioate
  modified_base 58: mod_base = OTHER; note = Guanosine phosphorothioate
  modified_base 59: mod_base = OTHER; note = Adenine phosphorothioate
  modified_base 60: mod_base = OTHER; note = Cytosine phosphorothioate
  modified_base 61: mod_base = OTHER; note = Guanosine phosphorothioate

SEQ ID NO: 1074 - DNA, 62 bp, synthetic construct; identical to SEQ ID NO: 435
  source 1..62: mol_type = other DNA
  modified_base 46: mod_base = OTHER; note = Adenine phosphorothioate
  modified_base 47: mod_base = OTHER; note = Cytosine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Guanosine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Cytosine phosphorothioate
  modified_base 58: mod_base = OTHER; note = Guanosine phosphorothioate
  modified_base 59: mod_base = OTHER; note = Adenine phosphorothioate
  modified_base 60: mod_base = OTHER; note = Cytosine phosphorothioate
  modified_base 61: mod_base = OTHER; note = Guanosine phosphorothioate

SEQ ID NO: 1075 - DNA, 62 bp, synthetic construct; identical to SEQ ID NO: 436
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Cytosine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Guanosine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Cytosine phosphorothioate
  modified_base 57: mod_base = OTHER; note = Guanosine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Adenine phosphorothioate

SEQ ID NO: 1076 - DNA, 62 bp, synthetic construct; identical to SEQ ID NO: 437
  source 1..62: mol_type = other DNA
  modified_base 46: mod_base = OTHER; note = Cytosine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Guanosine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Cytosine phosphorothioate
  modified_base 57: mod_base = OTHER; note = Guanosine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Adenine phosphorothioate

SEQ ID NO: 1077 - DNA, 62 bp, synthetic construct; identical to SEQ ID NO: 438
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Cytosine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Guanosine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Cytosine phosphorothioate
  modified_base 57: mod_base = OTHER; note = Guanosine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Adenine phosphorothioate

SEQ ID NO: 1078 - DNA, 62 bp, synthetic construct; identical to SEQ ID NO: 439
  source 1..62: mol_type = other DNA
  modified_base 46: mod_base = OTHER; note = Cytosine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Guanosine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Cytosine phosphorothioate
  modified_base 57: mod_base = OTHER; note = Guanosine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Adenine phosphorothioate

SEQ ID NO: 1079 - DNA, 62 bp, synthetic construct; identical to SEQ ID NO: 440
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Cytosine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Guanosine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Cytosine phosphorothioate
  modified_base 57: mod_base = OTHER; note = Guanosine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Cytosine phosphorothioate

SEQ ID NO: 1080 - DNA, 62 bp, synthetic construct; identical to SEQ ID NO: 441
  source 1..62: mol_type = other DNA
  modified_base 46: mod_base = OTHER; note = Cytosine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Guanosine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Cytosine phosphorothioate
  modified_base 57: mod_base = OTHER; note = Guanosine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Cytosine phosphorothioate

SEQ ID NO: 1081 - DNA, 62 bp, synthetic construct; identical to SEQ ID NO: 442
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Cytosine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Guanosine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Cytosine phosphorothioate
  modified_base 57: mod_base = OTHER; note = Guanosine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Guanosine phosphorothioate

SEQ ID NO: 1082 - DNA, 62 bp, synthetic construct; identical to SEQ ID NO: 443
  source 1..62: mol_type = other DNA
  modified_base 46: mod_base = OTHER; note = Cytosine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Guanosine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Cytosine phosphorothioate
  modified_base 57: mod_base = OTHER; note = Guanosine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Guanosine phosphorothioate

SEQ ID NO: 1083 - DNA, 62 bp, synthetic construct; identical to SEQ ID NO: 444
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Guanosine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Cytosine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Thymine phosphorothioate

SEQ ID NO: 1084 - DNA, 62 bp, synthetic construct; identical to SEQ ID NO: 445
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Guanosine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Cytosine phosphorothioate
  modified_base 56: mod_base = OTHER; note = Guanosine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Thymine phosphorothioate

SEQ ID NO: 1085 - DNA, 62 bp, synthetic construct; identical to SEQ ID NO: 446
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Cytosine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Cytosine phosphorothioate
  modified_base 56: mod_base = OTHER; note = Guanosine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Adenine phosphorothioate

SEQ ID NO: 1086 - DNA, 62 bp, synthetic construct; identical to SEQ ID NO: 447
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Guanosine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Cytosine phosphorothioate
  modified_base 56: mod_base = OTHER; note = Guanosine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Adenine phosphorothioate

SEQ ID NO: 1087 - DNA, 62 bp, synthetic construct; identical to SEQ ID NO: 448
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Cytosine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Cytosine phosphorothioate
  modified_base 56: mod_base = OTHER; note = Guanosine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Cytosine phosphorothioate

SEQ ID NO: 1088 - DNA, 62 bp, synthetic construct; identical to SEQ ID NO: 449
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Guanosine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Cytosine phosphorothioate
  modified_base 56: mod_base = OTHER; note = Guanosine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Cytosine phosphorothioate

SEQ ID NO: 1089 - DNA, 62 bp, synthetic construct; identical to SEQ ID NO: 450
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Cytosine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Cytosine phosphorothioate
  modified_base 56: mod_base = OTHER; note = Guanosine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Cytosine phosphorothioate
  modified_base 60: mod_base = OTHER; note = Adenine phosphorothioate
  modified_base 61: mod_base = OTHER; note = Cytosine phosphorothioate

SEQ ID NO: 1090 - DNA, 62 bp, synthetic construct; identical to SEQ ID NO: 451
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Guanosine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Cytosine phosphorothioate
  modified_base 56: mod_base = OTHER; note = Guanosine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Cytosine phosphorothioate
  modified_base 60: mod_base = OTHER; note = Adenine phosphorothioate
  modified_base 61: mod_base = OTHER; note = Cytosine phosphorothioate

SEQ ID NO: 1091 - DNA, 62 bp, synthetic construct; identical to SEQ ID NO: 452
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Cytosine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Guanosine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Cytosine phosphorothioate
  modified_base 55: mod_base = OTHER; note = Guanosine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Adenine phosphorothioate

SEQ ID NO: 1092 - DNA, 62 bp, synthetic construct; identical to SEQ ID NO: 453
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Guanosine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Cytosine phosphorothioate
  modified_base 55: mod_base = OTHER; note = Guanosine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Adenine phosphorothioate

SEQ ID NO: 1093 - DNA, 62 bp, synthetic construct; identical to SEQ ID NO: 454
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Cytosine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Guanosine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Cytosine phosphorothioate
  modified_base 55: mod_base = OTHER; note = Guanosine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Cytosine phosphorothioate

SEQ ID NO: 1094 - DNA, 62 bp, synthetic construct; identical to SEQ ID NO: 455
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Cytosine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Guanosine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Cytosine phosphorothioate
  modified_base 55: mod_base = OTHER; note = Guanosine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Cytosine phosphorothioate
  modified_base 60: mod_base = OTHER; note = Adenine phosphorothioate
  modified_base 61: mod_base = OTHER; note = Cytosine phosphorothioate

SEQ ID NO: 1095 - DNA, 62 bp, synthetic construct; identical to SEQ ID NO: 456
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Guanosine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Cytosine phosphorothioate
  modified_base 55: mod_base = OTHER; note = Guanosine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Cytosine phosphorothioate
  modified_base 60: mod_base = OTHER; note = Adenine phosphorothioate
  modified_base 61: mod_base = OTHER; note = Cytosine phosphorothioate

SEQ ID NO: 1096 - DNA, 62 bp, synthetic construct; identical to SEQ ID NO: 457
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Cytosine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Guanosine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Cytosine phosphorothioate
  modified_base 55: mod_base = OTHER; note = Guanosine phosphorothioate
  modified_base 56: mod_base = OTHER; note = Guanosine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Cytosine phosphorothioate
  modified_base 60: mod_base = OTHER; note = Adenine phosphorothioate
  modified_base 61: mod_base = OTHER; note = Cytosine phosphorothioate

SEQ ID NO: 1097 - DNA, 62 bp, synthetic construct; identical to SEQ ID NO: 458
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Cytosine phosphorothioate
  modified_base 58: mod_base = OTHER; note = Guanosine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Thymine phosphorothioate

SEQ ID NO: 1098 - DNA, 62 bp, synthetic construct; identical to SEQ ID NO: 459
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Cytosine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Cytosine phosphorothioate
  modified_base 58: mod_base = OTHER; note = Guanosine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Thymine phosphorothioate

SEQ ID NO: 1099 - DNA, 62 bp, synthetic construct; identical to SEQ ID NO: 460
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Cytosine phosphorothioate
  modified_base 58: mod_base = OTHER; note = Guanosine phosphorothioate
  modified_base 59: mod_base = OTHER; note = Thymine phosphorothioate
  modified_base 60: mod_base = OTHER; note = Guanosine phosphorothioate
  modified_base 61: mod_base = OTHER; note = Thymine phosphorothioate

SEQ ID NO: 1100 - DNA, 62 bp, synthetic construct; identical to SEQ ID NO: 461
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Cytosine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Cytosine phosphorothioate
  modified_base 58: mod_base = OTHER; note = Guanosine phosphorothioate
  modified_base 59: mod_base = OTHER; note = Thymine phosphorothioate
  modified_base 60: mod_base = OTHER; note = Guanosine phosphorothioate
  modified_base 61: mod_base = OTHER; note = Thymine phosphorothioate

SEQ ID NO: 1101 - DNA, 62 bp, synthetic construct; identical to SEQ ID NO: 462
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Cytosine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Cytosine phosphorothioate
  modified_base 58: mod_base = OTHER; note = Guanosine phosphorothioate
  modified_base 59: mod_base = OTHER; note = Thymine phosphorothioate
  modified_base 60: mod_base = OTHER; note = Guanosine phosphorothioate
  modified_base 61: mod_base = OTHER; note = Thymine phosphorothioate

SEQ ID NO: 1102 - DNA, 62 bp, synthetic construct; identical to SEQ ID NO: 463
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Cytosine phosphorothioate
  modified_base 58: mod_base = OTHER; note = Guanosine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Cytosine phosphorothioate

SEQ ID NO: 1103 - DNA, 62 bp, synthetic construct; identical to SEQ ID NO: 464
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Cytosine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Cytosine phosphorothioate
  modified_base 58: mod_base = OTHER; note = Guanosine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Cytosine phosphorothioate

SEQ ID NO: 1104 - DNA, 62 bp, synthetic construct; identical to SEQ ID NO: 465
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Cytosine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Cytosine phosphorothioate
  modified_base 58: mod_base = OTHER; note = Guanosine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Cytosine phosphorothioate

SEQ ID NO: 1105 - DNA, 62 bp, synthetic construct; identical to SEQ ID NO: 466
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Cytosine phosphorothioate
  modified_base 58: mod_base = OTHER; note = Guanosine phosphorothioate
  modified_base 59: mod_base = OTHER; note = Adenine phosphorothioate
  modified_base 60: mod_base = OTHER; note = Cytosine phosphorothioate
  modified_base 61: mod_base = OTHER; note = Guanosine phosphorothioate

SEQ ID NO: 1106 - DNA, 62 bp, synthetic construct; identical to SEQ ID NO: 467
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Cytosine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Cytosine phosphorothioate
  modified_base 58: mod_base = OTHER; note = Guanosine phosphorothioate
  modified_base 59: mod_base = OTHER; note = Adenine phosphorothioate
  modified_base 60: mod_base = OTHER; note = Cytosine phosphorothioate
  modified_base 61: mod_base = OTHER; note = Guanosine phosphorothioate

SEQ ID NO: 1107 - DNA, 62 bp, synthetic construct; identical to SEQ ID NO: 468
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Cytosine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Cytosine phosphorothioate
  modified_base 58: mod_base = OTHER; note = Guanosine phosphorothioate
  modified_base 59: mod_base = OTHER; note = Adenine phosphorothioate
  modified_base 60: mod_base = OTHER; note = Cytosine phosphorothioate
  modified_base 61: mod_base = OTHER; note = Guanosine phosphorothioate

SEQ ID NO: 1108 - DNA, 72 bp, synthetic construct; identical to SEQ ID NO: 469
  source 1..72: mol_type = other DNA
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Thymine phosphorothioate
  modified_base 62: mod_base = OTHER; note = Cytosine phosphorothioate
  modified_base 63: mod_base = OTHER; note = Adenine phosphorothioate
  modified_base 64: mod_base = OTHER; note = Thymine phosphorothioate
  modified_base 65: mod_base = OTHER; note = Guanosine phosphorothioate
  modified_base 66: mod_base = OTHER; note = Thymine phosphorothioate

SEQ ID NO: 1109 - DNA, 72 bp, synthetic construct; identical to SEQ ID NO: 470
  source 1..72: mol_type = other DNA
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Cytosine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Thymine phosphorothioate
  modified_base 62: mod_base = OTHER; note = Cytosine phosphorothioate
  modified_base 63: mod_base = OTHER; note = Adenine phosphorothioate
  modified_base 64: mod_base = OTHER; note = Thymine phosphorothioate
  modified_base 65: mod_base = OTHER; note = Guanosine phosphorothioate
  modified_base 66: mod_base = OTHER; note = Thymine phosphorothioate

SEQ ID NO: 1110 - DNA, 72 bp, synthetic construct; identical to SEQ ID NO: 471
  source 1..72: mol_type = other DNA
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Cytosine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Thymine phosphorothioate
  modified_base 62: mod_base = OTHER; note = Cytosine phosphorothioate
  modified_base 63: mod_base = OTHER; note = Adenine phosphorothioate
  modified_base 64: mod_base = OTHER; note = Thymine phosphorothioate
  modified_base 65: mod_base = OTHER; note = Guanosine phosphorothioate
  modified_base 66: mod_base = OTHER; note = Thymine phosphorothioate

SEQ ID NO: 1111 - DNA, 72 bp, synthetic construct; identical to SEQ ID NO: 472
  source 1..72: mol_type = other DNA
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Thymine phosphorothioate
  modified_base 62: mod_base = OTHER; note = Cytosine phosphorothioate
  modified_base 63: mod_base = OTHER; note = Adenine phosphorothioate
  modified_base 64: mod_base = OTHER; note = Thymine phosphorothioate
  modified_base 65: mod_base = OTHER; note = Guanosine phosphorothioate
  modified_base 66: mod_base = OTHER; note = Thymine phosphorothioate

SEQ ID NO: 1112 - DNA, 72 bp, synthetic construct; identical to SEQ ID NO: 473
  source 1..72: mol_type = other DNA
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Thymine phosphorothioate
  modified_base 62: mod_base = OTHER; note = Cytosine phosphorothioate
  modified_base 63: mod_base = OTHER; note = Guanosine phosphorothioate
  modified_base 64: mod_base = OTHER; note = Thymine phosphorothioate
  modified_base 65: mod_base = OTHER; note = Guanosine phosphorothioate
  modified_base 66: mod_base = OTHER; note = Thymine phosphorothioate

SEQ ID NO: 1113 - DNA, 72 bp, synthetic construct; identical to SEQ ID NO: 474
  source 1..72: mol_type = other DNA
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Cytosine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Thymine phosphorothioate
  modified_base 62: mod_base = OTHER; note = Cytosine phosphorothioate
  modified_base 63: mod_base = OTHER; note = Guanosine phosphorothioate
  modified_base 64: mod_base = OTHER; note = Thymine phosphorothioate
  modified_base 65: mod_base = OTHER; note = Guanosine phosphorothioate
  modified_base 66: mod_base = OTHER; note = Thymine phosphorothioate

SEQ ID NO: 1114 - DNA, 72 bp, synthetic construct; identical to SEQ ID NO: 475
  source 1..72: mol_type = other DNA
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Cytosine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Thymine phosphorothioate
  modified_base 62: mod_base = OTHER; note = Cytosine phosphorothioate
  modified_base 63: mod_base = OTHER; note = Guanosine phosphorothioate
  modified_base 64: mod_base = OTHER; note = Thymine phosphorothioate
  modified_base 65: mod_base = OTHER; note = Guanosine phosphorothioate
  modified_base 66: mod_base = OTHER; note = Thymine phosphorothioate

SEQ ID NO: 1115 - DNA, 72 bp, synthetic construct; identical to SEQ ID NO: 476
  source 1..72: mol_type = other DNA
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Thymine phosphorothioate
  modified_base 62: mod_base = OTHER; note = Cytosine phosphorothioate
  modified_base 63: mod_base = OTHER; note = Guanosine phosphorothioate
  modified_base 64: mod_base = OTHER; note = Thymine phosphorothioate
  modified_base 65: mod_base = OTHER; note = Adenine phosphorothioate
  modified_base 66: mod_base = OTHER; note = Thymine phosphorothioate

SEQ ID NO: 1116 - DNA, 72 bp, synthetic construct; identical to SEQ ID NO: 477
  source 1..72: mol_type = other DNA
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Cytosine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Thymine phosphorothioate
  modified_base 62: mod_base = OTHER; note = Cytosine phosphorothioate
  modified_base 63: mod_base = OTHER; note = Guanosine phosphorothioate
  modified_base 64: mod_base = OTHER; note = Thymine phosphorothioate
  modified_base 65: mod_base = OTHER; note = Adenine phosphorothioate
  modified_base 66: mod_base = OTHER; note = Thymine phosphorothioate

SEQ ID NO: 1117 - DNA, 72 bp, synthetic construct; identical to SEQ ID NO: 478
  source 1..72: mol_type = other DNA
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Cytosine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Thymine phosphorothioate
  modified_base 62: mod_base = OTHER; note = Cytosine phosphorothioate
  modified_base 63: mod_base = OTHER; note = Guanosine phosphorothioate
  modified_base 64: mod_base = OTHER; note = Thymine phosphorothioate
  modified_base 65: mod_base = OTHER; note = Adenine phosphorothioate
  modified_base 66: mod_base = OTHER; note = Thymine phosphorothioate

SEQ ID NO: 1118 - DNA, 62 bp, synthetic construct; identical to SEQ ID NO: 479
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Guanosine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Adenine phosphorothioate

SEQ ID NO: 1119 - DNA, 62 bp, synthetic construct; identical to SEQ ID NO: 480
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Guanosine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Adenine phosphorothioate

SEQ ID NO: 1120 - DNA, 62 bp, synthetic construct; identical to SEQ ID NO: 481
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Cytosine phosphorothioate
  modified_base 57: mod_base = OTHER; note = Guanosine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Adenine phosphorothioate

SEQ ID NO: 1121 - DNA, 62 bp, synthetic construct; identical to SEQ ID NO: 482
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Cytosine phosphorothioate
  modified_base 57: mod_base = OTHER; note = Guanosine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Adenine phosphorothioate

SEQ ID NO: 1122 - DNA, 62 bp, synthetic construct; identical to SEQ ID NO: 483
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Cytosine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Cytosine phosphorothioate
  modified_base 57: mod_base = OTHER; note = Guanosine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Adenine phosphorothioate

SEQ ID NO: 1123 - DNA, 62 bp, synthetic construct; identical to SEQ ID NO: 484
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Guanosine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Cytosine phosphorothioate

SEQ ID NO: 1124 - DNA, 62 bp, synthetic construct; identical to SEQ ID NO: 485
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Cytosine phosphorothioate
  modified_base 57: mod_base = OTHER; note = Guanosine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Adenine phosphorothioate

SEQ ID NO: 1125 - DNA, 62 bp, synthetic construct; identical to SEQ ID NO: 486
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Cytosine phosphorothioate
  modified_base 57: mod_base = OTHER; note = Guanosine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Adenine phosphorothioate

SEQ ID NO: 1126 - DNA, 62 bp, synthetic construct; identical to SEQ ID NO: 487
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Cytosine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Cytosine phosphorothioate
  modified_base 57: mod_base = OTHER; note = Guanosine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Adenine phosphorothioate

SEQ ID NO: 1127 - DNA, 62 bp, synthetic construct; identical to SEQ ID NO: 488
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Cytosine phosphorothioate
  modified_base 57: mod_base = OTHER; note = Guanosine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Cytosine phosphorothioate

SEQ ID NO: 1128 - DNA, 62 bp, synthetic construct; identical to SEQ ID NO: 489
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Cytosine phosphorothioate
  modified_base 57: mod_base = OTHER; note = Guanosine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Cytosine phosphorothioate

SEQ ID NO: 1129 - DNA, 62 bp, synthetic construct; identical to SEQ ID NO: 490
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Cytosine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Cytosine phosphorothioate
  modified_base 57: mod_base = OTHER; note = Guanosine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Cytosine phosphorothioate

SEQ ID NO: 1130 - DNA, 62 bp, synthetic construct; identical to SEQ ID NO: 491
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Guanosine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Guanosine phosphorothioate

SEQ ID NO: 1131 - DNA, 62 bp, synthetic construct; identical to SEQ ID NO: 492
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Cytosine phosphorothioate
  modified_base 57: mod_base = OTHER; note = Guanosine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Guanosine phosphorothioate

SEQ ID NO: 1132 - DNA, 62 bp, synthetic construct; identical to SEQ ID NO: 493
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Cytosine phosphorothioate
  modified_base 57: mod_base = OTHER; note = Guanosine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Guanosine phosphorothioate

SEQ ID NO: 1133 - DNA, 62 bp, synthetic construct; identical to SEQ ID NO: 494
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Cytosine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Cytosine phosphorothioate
  modified_base 57: mod_base = OTHER; note = Guanosine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Guanosine phosphorothioate

SEQ ID NO: 1134 - DNA, 70 bp, synthetic construct; identical to SEQ ID NO: 495
  source 1..70: mol_type = other DNA
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Guanosine phosphorothioate
  modified_base 62: mod_base = OTHER; note = Thymine phosphorothioate
  modified_base 63: mod_base = OTHER; note = Guanosine phosphorothioate
  modified_base 64: mod_base = OTHER; note = Adenine phosphorothioate
  modified_base 65: mod_base = OTHER; note = Thymine phosphorothioate

SEQ ID NO: 1135 - DNA, 70 bp, synthetic construct; identical to SEQ ID NO: 496
  source 1..70: mol_type = other DNA
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Guanosine phosphorothioate
  modified_base 64: mod_base = OTHER; note = Thymine phosphorothioate
  modified_base 65: mod_base = OTHER; note = Adenine phosphorothioate

SEQ ID NO: 1136 - DNA, 70 bp, synthetic construct; identical to SEQ ID NO: 497
  source 1..70: mol_type = other DNA
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Guanosine phosphorothioate
  modified_base 64: mod_base = OTHER; note = Thymine phosphorothioate
  modified_base 65: mod_base = OTHER; note = Adenine phosphorothioate

SEQ ID NO: 1137 - DNA, 70 bp, synthetic construct; identical to SEQ ID NO: 498
  source 1..70: mol_type = other DNA
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Guanosine phosphorothioate
  modified_base 62: mod_base = OTHER; note = Thymine phosphorothioate
  modified_base 63: mod_base = OTHER; note = Guanosine phosphorothioate
  modified_base 64: mod_base = OTHER; note = Thymine phosphorothioate
  modified_base 65: mod_base = OTHER; note = Adenine phosphorothioate

SEQ ID NO: 1138 - DNA, 70 bp, synthetic construct; identical to SEQ ID NO: 499
  source 1..70: mol_type = other DNA
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Guanosine phosphorothioate
  modified_base 64: mod_base = OTHER; note = Thymine phosphorothioate
  modified_base 65: mod_base = OTHER; note = Adenine phosphorothioate

SEQ ID NO: 1139 - DNA, 70 bp, synthetic construct; identical to SEQ ID NO: 500
  source 1..70: mol_type = other DNA
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Guanosine phosphorothioate
  modified_base 64: mod_base = OTHER; note = Thymine phosphorothioate
  modified_base 65: mod_base = OTHER; note = Adenine phosphorothioate

SEQ ID NO: 1140 - DNA, 70 bp, synthetic construct; identical to SEQ ID NO: 501
  source 1..70: mol_type = other DNA
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Cytosine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Guanosine phosphorothioate
  modified_base 64: mod_base = OTHER; note = Thymine phosphorothioate
  modified_base 65: mod_base = OTHER; note = Adenine phosphorothioate

SEQ ID NO: 1141 - DNA, 70 bp, synthetic construct; identical to SEQ ID NO: 502
  source 1..70: mol_type = other DNA
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Guanosine phosphorothioate
  modified_base 62: mod_base = OTHER; note = Thymine phosphorothioate
  modified_base 63: mod_base = OTHER; note = Adenine phosphorothioate
  modified_base 64: mod_base = OTHER; note = Thymine phosphorothioate
  modified_base 65: mod_base = OTHER; note = Adenine phosphorothioate

SEQ ID NO: 1142 - DNA, 70 bp, synthetic construct; identical to SEQ ID NO: 503
  source 1..70: mol_type = other DNA
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Guanosine phosphorothioate
  modified_base 62: mod_base = OTHER; note = Thymine phosphorothioate
  modified_base 63: mod_base = OTHER; note = Guanosine phosphorothioate
  modified_base 64: mod_base = OTHER; note = Thymine phosphorothioate
  modified_base 65: mod_base = OTHER; note = Adenine phosphorothioate

SEQ ID NO: 1143 - DNA, 70 bp, synthetic construct; identical to SEQ ID NO: 504
  source 1..70: mol_type = other DNA
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Guanosine phosphorothioate
  modified_base 62: mod_base = OTHER; note = Thymine phosphorothioate
  modified_base 63: mod_base = OTHER; note = Guanosine phosphorothioate
  modified_base 64: mod_base = OTHER; note = Thymine phosphorothioate
  modified_base 65: mod_base = OTHER; note = Adenine phosphorothioate

SEQ ID NO: 1144 - DNA, 70 bp, synthetic construct; identical to SEQ ID NO: 505
  source 1..70: mol_type = other DNA
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Cytosine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Guanosine phosphorothioate
  modified_base 62: mod_base = OTHER; note = Thymine phosphorothioate
  modified_base 63: mod_base = OTHER; note = Guanosine phosphorothioate
  modified_base 64: mod_base = OTHER; note = Thymine phosphorothioate
  modified_base 65: mod_base = OTHER; note = Adenine phosphorothioate

SEQ ID NO: 1145 - DNA, 70 bp, synthetic construct; identical to SEQ ID NO: 506
  source 1..70: mol_type = other DNA
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Guanosine phosphorothioate
  modified_base 62: mod_base = OTHER; note = Thymine phosphorothioate
  modified_base 63: mod_base = OTHER; note = Adenine phosphorothioate
  modified_base 64: mod_base = OTHER; note = Thymine phosphorothioate
  modified_base 65: mod_base = OTHER; note = Adenine phosphorothioate

SEQ ID NO: 1146 - DNA, 70 bp, synthetic construct; identical to SEQ ID NO: 507
  source 1..70: mol_type = other DNA
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Guanosine phosphorothioate
  modified_base 62: mod_base = OTHER; note = Thymine phosphorothioate
  modified_base 63: mod_base = OTHER; note = Adenine phosphorothioate
  modified_base 64: mod_base = OTHER; note = Thymine phosphorothioate
  modified_base 65: mod_base = OTHER; note = Adenine phosphorothioate

SEQ ID NO: 1147 - DNA, 70 bp, synthetic construct; identical to SEQ ID NO: 508
  source 1..70: mol_type = other DNA
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Cytosine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Guanosine phosphorothioate
  modified_base 62: mod_base = OTHER; note = Thymine phosphorothioate
  modified_base 63: mod_base = OTHER; note = Adenine phosphorothioate
  modified_base 64: mod_base = OTHER; note = Thymine phosphorothioate
  modified_base 65: mod_base = OTHER; note = Adenine phosphorothioate

SEQ ID NO: 1148 - DNA, 62 bp, synthetic construct; identical to SEQ ID NO: 509
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Cytosine phosphorothioate
  modified_base 56: mod_base = OTHER; note = Guanosine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Thymine phosphorothioate

SEQ ID NO: 1149 - DNA, 62 bp, synthetic construct; identical to SEQ ID NO: 510
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Cytosine phosphorothioate
  modified_base 56: mod_base = OTHER; note = Guanosine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Adenine phosphorothioate

SEQ ID NO: 1150 - DNA, 62 bp, synthetic construct; identical to SEQ ID NO: 511
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Cytosine phosphorothioate
  modified_base 56: mod_base = OTHER; note = Guanosine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Cytosine phosphorothioate

SEQ ID NO: 1151 - DNA, 62 bp, synthetic construct; identical to SEQ ID NO: 512
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Cytosine phosphorothioate
  modified_base 56: mod_base = OTHER; note = Guanosine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Cytosine phosphorothioate
  modified_base 60: mod_base = OTHER; note = Adenine phosphorothioate
  modified_base 61: mod_base = OTHER; note = Cytosine phosphorothioate

SEQ ID NO: 1152 - DNA, 68 bp, synthetic construct; identical to SEQ ID NO: 513
  source 1..68: mol_type = other DNA
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Cytosine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Guanosine phosphorothioate
  modified_base 62: mod_base = OTHER; note = Thymine phosphorothioate
  modified_base 63: mod_base = OTHER; note = Adenine phosphorothioate
  modified_base 64: mod_base = OTHER; note = Thymine phosphorothioate

SEQ ID NO: 1153 - DNA, 68 bp, synthetic construct; identical to SEQ ID NO: 514
  source 1..68: mol_type = other DNA
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Cytosine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Guanosine phosphorothioate
  modified_base 62: mod_base = OTHER; note = Thymine phosphorothioate
  modified_base 63: mod_base = OTHER; note = Adenine phosphorothioate
  modified_base 64: mod_base = OTHER; note = Thymine phosphorothioate

SEQ ID NO: 1154 - DNA, 68 bp, synthetic construct; identical to SEQ ID NO: 515
  source 1..68: mol_type = other DNA
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Cytosine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Guanosine phosphorothioate
  modified_base 62: mod_base = OTHER; note = Thymine phosphorothioate
  modified_base 63: mod_base = OTHER; note = Adenine phosphorothioate
  modified_base 64: mod_base = OTHER; note = Thymine phosphorothioate

SEQ ID NO: 1155 - DNA, 68 bp, synthetic construct; identical to SEQ ID NO: 516
  source 1..68: mol_type = other DNA
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Cytosine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Adenine phosphorothioate
  modified_base 64: mod_base = OTHER; note = Thymine phosphorothioate

SEQ ID NO: 1156 - DNA, 62 bp, synthetic construct; identical to SEQ ID NO: 517
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Cytosine phosphorothioate
  modified_base 55: mod_base = OTHER; note = Guanosine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Adenine phosphorothioate

SEQ ID NO: 1157 - DNA, 62 bp, synthetic construct; identical to SEQ ID NO: 518
  source 1..62: mol_type = other DNA
  modified_base 46: mod_base = OTHER; note = Adenine phosphorothioate
  modified_base 47: mod_base = OTHER; note = Cytosine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Cytosine phosphorothioate
  modified_base 55: mod_base = OTHER; note = Guanosine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Adenine phosphorothioate

SEQ ID NO: 1158 - DNA, 62 bp, synthetic construct; identical to SEQ ID NO: 519
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Cytosine phosphorothioate
  modified_base 55: mod_base = OTHER; note = Guanosine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Cytosine phosphorothioate

SEQ ID NO: 1159 - DNA, 62 bp, synthetic construct; identical to SEQ ID NO: 520
  source 1..62: mol_type = other DNA
  modified_base 46: mod_base = OTHER; note = Adenine phosphorothioate
  modified_base 47: mod_base = OTHER; note = Cytosine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Cytosine phosphorothioate
  modified_base 55: mod_base = OTHER; note = Guanosine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Cytosine phosphorothioate

SEQ ID NO: 1160 - DNA, 62 bp, synthetic construct; identical to SEQ ID NO: 521
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Guanosine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Cytosine phosphorothioate
  modified_base 55: mod_base = OTHER; note = Guanosine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Cytosine phosphorothioate

SEQ ID NO: 1161 - DNA, 62 bp, synthetic construct; identical to SEQ ID NO: 522
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Cytosine phosphorothioate
  modified_base 55: mod_base = OTHER; note = Guanosine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Cytosine phosphorothioate
  modified_base 60: mod_base = OTHER; note = Adenine phosphorothioate
  modified_base 61: mod_base = OTHER; note = Cytosine phosphorothioate

SEQ ID NO: 1162 - DNA, 62 bp, synthetic construct; identical to SEQ ID NO: 523
  source 1..62: mol_type = other DNA
  modified_base 46: mod_base = OTHER; note = Adenine phosphorothioate
  modified_base 47: mod_base = OTHER; note = Cytosine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Cytosine phosphorothioate
  modified_base 55: mod_base = OTHER; note = Guanosine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Cytosine phosphorothioate
  modified_base 60: mod_base = OTHER; note = Adenine phosphorothioate
  modified_base 61: mod_base = OTHER; note = Cytosine phosphorothioate

SEQ ID NO: 1163 - DNA, 62 bp, synthetic construct; identical to SEQ ID NO: 524
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Cytosine phosphorothioate
  modified_base 55: mod_base = OTHER; note = Guanosine phosphorothioate
  modified_base 56: mod_base = OTHER; note = Guanosine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Cytosine phosphorothioate
  modified_base 60: mod_base = OTHER; note = Adenine phosphorothioate
  modified_base 61: mod_base = OTHER; note = Cytosine phosphorothioate

SEQ ID NO: 1164 - DNA, 62 bp, synthetic construct; identical to SEQ ID NO: 525
  source 1..62: mol_type = other DNA
  modified_base 46: mod_base = OTHER; note = Adenine phosphorothioate
  modified_base 47: mod_base = OTHER; note = Cytosine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Cytosine phosphorothioate
  modified_base 55: mod_base = OTHER; note = Guanosine phosphorothioate
  modified_base 56: mod_base = OTHER; note = Guanosine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Cytosine phosphorothioate
  modified_base 60: mod_base = OTHER; note = Adenine phosphorothioate
  modified_base 61: mod_base = OTHER; note = Cytosine phosphorothioate

SEQ ID NO: 1165 - DNA, 62 bp, synthetic construct; identical to SEQ ID NO: 526
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Guanosine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Cytosine phosphorothioate
  modified_base 55: mod_base = OTHER; note = Guanosine phosphorothioate
  modified_base 56: mod_base = OTHER; note = Guanosine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Cytosine phosphorothioate
  modified_base 60: mod_base = OTHER; note = Adenine phosphorothioate
  modified_base 61: mod_base = OTHER; note = Cytosine phosphorothioate

SEQ ID NO: 1166 - DNA, 66 bp, synthetic construct; identical to SEQ ID NO: 527
  source 1..66: mol_type = other DNA
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Cytosine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Adenine phosphorothioate

SEQ ID NO: 1167 - DNA, 66 bp, synthetic construct; identical to SEQ ID NO: 528
  source 1..66: mol_type = other DNA
  modified_base 48: mod_base = OTHER; note = Adenine phosphorothioate
  modified_base 49: mod_base = OTHER; note = Cytosine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Cytosine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Adenine phosphorothioate

SEQ ID NO: 1168 - DNA, 66 bp, synthetic construct; identical to SEQ ID NO: 529
  source 1..66: mol_type = other DNA
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Guanosine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Cytosine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Adenine phosphorothioate

SEQ ID NO: 1169 - DNA, 66 bp, synthetic construct; identical to SEQ ID NO: 530
  source 1..66: mol_type = other DNA
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Cytosine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Adenine phosphorothioate

SEQ ID NO: 1170 - DNA, 66 bp, synthetic construct; identical to SEQ ID NO: 531
  source 1..66: mol_type = other DNA
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Cytosine phosphorothioate
  modified_base 57: mod_base = OTHER; note = Guanosine phosphorothioate
  modified_base 58: mod_base = OTHER; note = Thymine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Adenine phosphorothioate

SEQ ID NO: 1171 - DNA, 66 bp, synthetic construct; identical to SEQ ID NO: 532
  source 1..66: mol_type = other DNA
  modified_base 48: mod_base = OTHER; note = Adenine phosphorothioate
  modified_base 49: mod_base = OTHER; note = Cytosine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Cytosine phosphorothioate
  modified_base 57: mod_base = OTHER; note = Guanosine phosphorothioate
  modified_base 58: mod_base = OTHER; note = Thymine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Adenine phosphorothioate

SEQ ID NO: 1172 - DNA, 66 bp, synthetic construct; identical to SEQ ID NO: 533
  source 1..66: mol_type = other DNA
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Guanosine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Cytosine phosphorothioate
  modified_base 57: mod_base = OTHER; note = Guanosine phosphorothioate
  modified_base 58: mod_base = OTHER; note = Thymine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Adenine phosphorothioate

SEQ ID NO: 1173 - DNA, 66 bp, synthetic construct; identical to SEQ ID NO: 534
  source 1..66: mol_type = other DNA
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Cytosine phosphorothioate
  modified_base 57: mod_base = OTHER; note = Guanosine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Adenine phosphorothioate

SEQ ID NO: 1174 - DNA, 66 bp, synthetic construct; identical to SEQ ID NO: 535
  source 1..66: mol_type = other DNA
  modified_base 48: mod_base = OTHER; note = Adenine phosphorothioate
  modified_base 49: mod_base = OTHER; note = Cytosine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Cytosine phosphorothioate
  modified_base 57: mod_base = OTHER; note = Guanosine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Adenine phosphorothioate

SEQ ID NO: 1175 - DNA, 66 bp, synthetic construct; identical to SEQ ID NO: 536
  source 1..66: mol_type = other DNA
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Guanosine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Cytosine phosphorothioate
  modified_base 57: mod_base = OTHER; note = Guanosine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Adenine phosphorothioate

SEQ ID NO: 1176 - DNA, 62 bp, synthetic construct; identical to SEQ ID NO: 537
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Cytosine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Guanosine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Adenine phosphorothioate

SEQ ID NO: 1177 - DNA, 62 bp, synthetic construct; identical to SEQ ID NO: 538
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Cytosine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Guanosine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Adenine phosphorothioate

SEQ ID NO: 1178 - DNA, 62 bp, synthetic construct; identical to SEQ ID NO: 539
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Cytosine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Guanosine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Cytosine phosphorothioate

SEQ ID NO: 1179 - DNA, 62 bp, synthetic construct; identical to SEQ ID NO: 540
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Cytosine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Guanosine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Cytosine phosphorothioate

SEQ ID NO: 1180 - DNA, 62 bp, synthetic construct; identical to SEQ ID NO: 541
  source 1..62: mol_type = other DNA
  modified_base 46: mod_base = OTHER; note = Cytosine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Guanosine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Cytosine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Guanosine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Cytosine phosphorothioate

SEQ ID NO: 1181 - DNA, 62 bp, synthetic construct; identical to SEQ ID NO: 542
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Cytosine phosphorothioate
  modified_base 53: mod_base = OTHER; note = Guanosine phosphorothioate
  modified_base 54: mod_base = OTHER; note = Thymine phosphorothioate
  modified_base 55: mod_base = OTHER; note = Guanosine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Cytosine phosphorothioate

SEQ ID NO: 1182 - DNA, 62 bp, synthetic construct; identical to SEQ ID NO: 543
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Cytosine phosphorothioate
  modified_base 53: mod_base = OTHER; note = Guanosine phosphorothioate
  modified_base 54: mod_base = OTHER; note = Thymine phosphorothioate
  modified_base 55: mod_base = OTHER; note = Guanosine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Cytosine phosphorothioate

SEQ ID NO: 1183 - DNA, 62 bp, synthetic construct; identical to SEQ ID NO: 544
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Cytosine phosphorothioate
  modified_base 53: mod_base = OTHER; note = Guanosine phosphorothioate
  modified_base 54: mod_base = OTHER; note = Thymine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Cytosine phosphorothioate
  modified_base 61: mod_base = OTHER; note = Cytosine phosphorothioate

SEQ ID NO: 1184 - DNA, 62 bp, synthetic construct; identical to SEQ ID NO: 545
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Cytosine phosphorothioate
  modified_base 53: mod_base = OTHER; note = Guanosine phosphorothioate
  modified_base 54: mod_base = OTHER; note = Thymine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Cytosine phosphorothioate
  modified_base 61: mod_base = OTHER; note = Cytosine phosphorothioate

SEQ ID NO: 1185 - DNA, 62 bp, synthetic construct; identical to SEQ ID NO: 546
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Cytosine phosphorothioate
  modified_base 53: mod_base = OTHER; note = Guanosine phosphorothioate
  modified_base 54: mod_base = OTHER; note = Thymine phosphorothioate
  modified_base 55: mod_base = OTHER; note = Guanosine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Cytosine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Cytosine phosphorothioate

SEQ ID NO: 1186 - DNA, 62 bp, synthetic construct; identical to SEQ ID NO: 547
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Cytosine phosphorothioate
  modified_base 53: mod_base = OTHER; note = Guanosine phosphorothioate
  modified_base 54: mod_base = OTHER; note = Thymine phosphorothioate
  modified_base 55: mod_base = OTHER; note = Guanosine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Cytosine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Cytosine phosphorothioate

SEQ ID NO: 1187 - DNA, 64 bp, synthetic construct; identical to SEQ ID NO: 548
  source 1..64: mol_type = other DNA
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Cytosine phosphorothioate
  modified_base 54: mod_base = OTHER; note = Adenine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Guanosine phosphorothioate
  modified_base 62: mod_base = OTHER; note = Thymine phosphorothioate

SEQ ID NO: 1188 - DNA, 64 bp, synthetic construct; identical to SEQ ID NO: 549
  source 1..64: mol_type = other DNA
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Cytosine phosphorothioate
  modified_base 54: mod_base = OTHER; note = Adenine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Guanosine phosphorothioate
  modified_base 62: mod_base = OTHER; note = Thymine phosphorothioate

SEQ ID NO: 1189 - DNA, 64 bp, synthetic construct; identical to SEQ ID NO: 550
  source 1..64: mol_type = other DNA
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Cytosine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Guanosine phosphorothioate
  modified_base 61: mod_base = OTHER; note = Thymine phosphorothioate
  modified_base 62: mod_base = OTHER; note = Adenine phosphorothioate

SEQ ID NO: 1190 - DNA, 64 bp, synthetic construct; identical to SEQ ID NO: 551
  source 1..64: mol_type = other DNA
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Cytosine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Guanosine phosphorothioate
  modified_base 61: mod_base = OTHER; note = Thymine phosphorothioate
  modified_base 62: mod_base = OTHER; note = Adenine phosphorothioate

SEQ ID NO: 1191 - DNA, 66 bp, synthetic construct; identical to SEQ ID NO: 552
  source 1..66: mol_type = other DNA
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Cytosine phosphorothioate
  modified_base 55: mod_base = OTHER; note = Adenine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Thymine phosphorothioate
  modified_base 62: mod_base = OTHER; note = Guanosine phosphorothioate
  modified_base 63: mod_base = OTHER; note = Adenine phosphorothioate

SEQ ID NO: 1192 - DNA, 66 bp, synthetic construct; identical to SEQ ID NO: 553
  source 1..66: mol_type = other DNA
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Cytosine phosphorothioate
  modified_base 55: mod_base = OTHER; note = Adenine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Thymine phosphorothioate
  modified_base 62: mod_base = OTHER; note = Guanosine phosphorothioate
  modified_base 63: mod_base = OTHER; note = Adenine phosphorothioate

SEQ ID NO: 1193 - DNA, 66 bp, synthetic construct; identical to SEQ ID NO: 554
  source 1..66: mol_type = other DNA
  modified_base 48: mod_base = OTHER; note = Cytosine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Guanosine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Cytosine phosphorothioate
  modified_base 55: mod_base = OTHER; note = Adenine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Thymine phosphorothioate
  modified_base 62: mod_base = OTHER; note = Guanosine phosphorothioate
  modified_base 63: mod_base = OTHER; note = Adenine phosphorothioate

SEQ ID NO: 1194 - DNA, 66 bp, synthetic construct; identical to SEQ ID NO: 555
  source 1..66: mol_type = other DNA
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Guanosine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Cytosine phosphorothioate
  modified_base 55: mod_base = OTHER; note = Adenine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Thymine phosphorothioate
  modified_base 62: mod_base = OTHER; note = Guanosine phosphorothioate
  modified_base 63: mod_base = OTHER; note = Adenine phosphorothioate

SEQ ID NO: 1195 - DNA, 68 bp, synthetic construct; identical to SEQ ID NO: 556
  source 1..68: mol_type = other DNA
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Guanosine phosphorothioate
  modified_base 62: mod_base = OTHER; note = Thymine phosphorothioate
  modified_base 63: mod_base = OTHER; note = Adenine phosphorothioate
  modified_base 64: mod_base = OTHER; note = Thymine phosphorothioate

SEQ ID NO: 1196 - DNA, 68 bp, synthetic construct; identical to SEQ ID NO: 557
  source 1..68: mol_type = other DNA
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Cytosine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Guanosine phosphorothioate
  modified_base 62: mod_base = OTHER; note = Thymine phosphorothioate
  modified_base 63: mod_base = OTHER; note = Adenine phosphorothioate
  modified_base 64: mod_base = OTHER; note = Thymine phosphorothioate

SEQ ID NO: 1197 - DNA, 68 bp, synthetic construct; identical to SEQ ID NO: 558
  source 1..68: mol_type = other DNA
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Guanosine phosphorothioate
  modified_base 62: mod_base = OTHER; note = Thymine phosphorothioate
  modified_base 63: mod_base = OTHER; note = Adenine phosphorothioate
  modified_base 64: mod_base = OTHER; note = Thymine phosphorothioate

SEQ ID NO: 1198 - DNA, 68 bp, synthetic construct; identical to SEQ ID NO: 559
  source 1..68: mol_type = other DNA
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Cytosine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Guanosine phosphorothioate
  modified_base 62: mod_base = OTHER; note = Thymine phosphorothioate
  modified_base 63: mod_base = OTHER; note = Adenine phosphorothioate
  modified_base 64: mod_base = OTHER; note = Thymine phosphorothioate

SEQ ID NO: 1199 - DNA, 68 bp, synthetic construct; identical to SEQ ID NO: 560
  source 1..68: mol_type = other DNA
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Guanosine phosphorothioate
  modified_base 62: mod_base = OTHER; note = Thymine phosphorothioate
  modified_base 63: mod_base = OTHER; note = Adenine phosphorothioate
  modified_base 64: mod_base = OTHER; note = Thymine phosphorothioate

SEQ ID NO: 1200 - DNA, 68 bp, synthetic construct; identical to SEQ ID NO: 561
  source 1..68: mol_type = other DNA
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Cytosine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Guanosine phosphorothioate
  modified_base 62: mod_base = OTHER; note = Thymine phosphorothioate
  modified_base 63: mod_base = OTHER; note = Adenine phosphorothioate
  modified_base 64: mod_base = OTHER; note = Thymine phosphorothioate

SEQ ID NO: 1201 - DNA, 68 bp, synthetic construct; identical to SEQ ID NO: 562
  source 1..68: mol_type = other DNA
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Guanosine phosphorothioate
  modified_base 62: mod_base = OTHER; note = Guanosine phosphorothioate
  modified_base 63: mod_base = OTHER; note = Adenine phosphorothioate
  modified_base 64: mod_base = OTHER; note = Thymine phosphorothioate

SEQ ID NO: 1202 - DNA, 68 bp, synthetic construct; identical to SEQ ID NO: 563
  source 1..68: mol_type = other DNA
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Cytosine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Guanosine phosphorothioate
  modified_base 62: mod_base = OTHER; note = Guanosine phosphorothioate
  modified_base 63: mod_base = OTHER; note = Adenine phosphorothioate
  modified_base 64: mod_base = OTHER; note = Thymine phosphorothioate

SEQ ID NO: 1203 - DNA, 68 bp, synthetic construct; identical to SEQ ID NO: 564
  source 1..68: mol_type = other DNA
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Cytosine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Guanosine phosphorothioate
  modified_base 62: mod_base = OTHER; note = Thymine phosphorothioate
  modified_base 63: mod_base = OTHER; note = Adenine phosphorothioate
  modified_base 64: mod_base = OTHER; note = Thymine phosphorothioate

SEQ ID NO: 1204 - DNA, 68 bp, synthetic construct; identical to SEQ ID NO: 565
  source 1..68: mol_type = other DNA
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Cytosine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Guanosine phosphorothioate
  modified_base 62: mod_base = OTHER; note = Thymine phosphorothioate
  modified_base 63: mod_base = OTHER; note = Adenine phosphorothioate
  modified_base 64: mod_base = OTHER; note = Thymine phosphorothioate

SEQ ID NO: 1205 - DNA, 68 bp, synthetic construct; identical to SEQ ID NO: 566
  source 1..68: mol_type = other DNA
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Cytosine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Guanosine phosphorothioate
  modified_base 62: mod_base = OTHER; note = Thymine phosphorothioate
  modified_base 63: mod_base = OTHER; note = Adenine phosphorothioate
  modified_base 64: mod_base = OTHER; note = Thymine phosphorothioate

SEQ ID NO: 1206 - DNA, 68 bp, synthetic construct; identical to SEQ ID NO: 567
  source 1..68: mol_type = other DNA
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Cytosine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Guanosine phosphorothioate
  modified_base 62: mod_base = OTHER; note = Guanosine phosphorothioate
  modified_base 63: mod_base = OTHER; note = Adenine phosphorothioate
  modified_base 64: mod_base = OTHER; note = Thymine phosphorothioate

SEQ ID NO: 1207 - DNA, 66 bp, synthetic construct; identical to SEQ ID NO: 568
  source 1..66: mol_type = other DNA
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Adenine phosphorothioate

SEQ ID NO: 1208 - DNA, 66 bp, synthetic construct; identical to SEQ ID NO: 569
  source 1..66: mol_type = other DNA
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Cytosine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Adenine phosphorothioate

SEQ ID NO: 1209 - DNA, 66 bp, synthetic construct; identical to SEQ ID NO: 570
  source 1..66: mol_type = other DNA
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Cytosine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Cytosine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Adenine phosphorothioate

SEQ ID NO: 1210 - DNA, 66 bp, synthetic construct; identical to SEQ ID NO: 571
  source 1..66: mol_type = other DNA
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Adenine phosphorothioate

SEQ ID NO: 1211 - DNA, 66 bp, synthetic construct; identical to SEQ ID NO: 572
  source 1..66: mol_type = other DNA
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Cytosine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Adenine phosphorothioate

SEQ ID NO: 1212 - DNA, 66 bp, synthetic construct; identical to SEQ ID NO: 573
  source 1..66: mol_type = other DNA
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Cytosine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Cytosine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Adenine phosphorothioate

SEQ ID NO: 1213 - DNA, 66 bp, synthetic construct; identical to SEQ ID NO: 574
  source 1..66: mol_type = other DNA
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Cytosine phosphorothioate

SEQ ID NO: 1214 - DNA, 66 bp, synthetic construct; identical to SEQ ID NO: 575
  source 1..66: mol_type = other DNA
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Cytosine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Cytosine phosphorothioate

SEQ ID NO: 1215 - DNA, 66 bp, synthetic construct; identical to SEQ ID NO: 576
  source 1..66: mol_type = other DNA
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Cytosine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Cytosine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Cytosine phosphorothioate

SEQ ID NO: 1216 - DNA, 66 bp, synthetic construct; identical to SEQ ID NO: 577
  source 1..66: mol_type = other DNA
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Guanosine phosphorothioate
  modified_base 60: mod_base = OTHER; note = Guanosine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Cytosine phosphorothioate

SEQ ID NO: 1217 - DNA, 66 bp, synthetic construct; identical to SEQ ID NO: 578
  source 1..66: mol_type = other DNA
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Cytosine phosphorothioate
  modified_base 59: mod_base = OTHER; note = Guanosine phosphorothioate
  modified_base 60: mod_base = OTHER; note = Guanosine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Cytosine phosphorothioate

SEQ ID NO: 1218 - DNA, 66 bp, synthetic construct; identical to SEQ ID NO: 579
  source 1..66: mol_type = other DNA
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Cytosine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Cytosine phosphorothioate
  modified_base 59: mod_base = OTHER; note = Guanosine phosphorothioate
  modified_base 60: mod_base = OTHER; note = Guanosine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Cytosine phosphorothioate

SEQ ID NO: 1219 - DNA, 66 bp, synthetic construct; identical to SEQ ID NO: 580
  source 1..66: mol_type = other DNA
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Cytosine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Adenine phosphorothioate

SEQ ID NO: 1220 - DNA, 66 bp, synthetic construct; identical to SEQ ID NO: 581
  source 1..66: mol_type = other DNA
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Cytosine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Adenine phosphorothioate

SEQ ID NO: 1221 - DNA, 66 bp, synthetic construct; identical to SEQ ID NO: 582
  source 1..66: mol_type = other DNA
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Cytosine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Cytosine phosphorothioate

SEQ ID NO: 1222 - DNA, 66 bp, synthetic construct; identical to SEQ ID NO: 583
  source 1..66: mol_type = other DNA
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Cytosine phosphorothioate
  modified_base 59: mod_base = OTHER; note = Guanosine phosphorothioate
  modified_base 60: mod_base = OTHER; note = Guanosine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Cytosine phosphorothioate

SEQ ID NO: 1223 - DNA, 62 bp, synthetic construct; identical to SEQ ID NO: 584
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Guanosine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Thymine phosphorothioate

SEQ ID NO: 1224 - DNA, 62 bp, synthetic construct; identical to SEQ ID NO: 585
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Cytosine phosphorothioate
  modified_base 58: mod_base = OTHER; note = Guanosine phosphorothioate
  modified_base 59: mod_base = OTHER; note = Thymine phosphorothioate
  modified_base 60: mod_base = OTHER; note = Guanosine phosphorothioate
  modified_base 61: mod_base = OTHER; note = Thymine phosphorothioate

SEQ ID NO: 1225 - DNA, 62 bp, synthetic construct; identical to SEQ ID NO: 586
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Adenine phosphorothioate
  modified_base 56: mod_base = OTHER; note = Guanosine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Thymine phosphorothioate

SEQ ID NO: 1226 - DNA, 62 bp, synthetic construct; identical to SEQ ID NO: 587
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Cytosine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Cytosine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Thymine phosphorothioate

SEQ ID NO: 1227 - DNA, 62 bp, synthetic construct; identical to SEQ ID NO: 588
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Cytosine phosphorothioate
  modified_base 56: mod_base = OTHER; note = Guanosine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Thymine phosphorothioate

SEQ ID NO: 1228 - DNA, 62 bp, synthetic construct; identical to SEQ ID NO: 589
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Adenine phosphorothioate
  modified_base 56: mod_base = OTHER; note = Guanosine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Cytosine phosphorothioate

SEQ ID NO: 1229 - DNA, 62 bp, synthetic construct; identical to SEQ ID NO: 590
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Guanosine phosphorothioate
  modified_base 54: mod_base = OTHER; note = Thymine phosphorothioate
  modified_base 55: mod_base = OTHER; note = Guanosine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Thymine phosphorothioate

SEQ ID NO: 1230 - DNA, 62 bp, synthetic construct; identical to SEQ ID NO: 591
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Cytosine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Guanosine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Adenine phosphorothioate

SEQ ID NO: 1231 - DNA, 62 bp, synthetic construct; identical to SEQ ID NO: 592
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Cytosine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Guanosine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Cytosine phosphorothioate

SEQ ID NO: 1232 - DNA, 62 bp, synthetic construct; identical to SEQ ID NO: 593
  source 1..62: mol_type = other DNA
  modified_base 46: mod_base = OTHER; note = Cytosine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Guanosine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Cytosine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Guanosine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Cytosine phosphorothioate

SEQ ID NO: 1233 - DNA, 62 bp, synthetic construct; identical to SEQ ID NO: 594
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Guanosine phosphorothioate
  modified_base 54: mod_base = OTHER; note = Thymine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Cytosine phosphorothioate
  modified_base 61: mod_base = OTHER; note = Cytosine phosphorothioate

SEQ ID NO: 1234 - DNA, 68 bp, synthetic construct; identical to SEQ ID NO: 595
  source 1..68: mol_type = other DNA
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Guanosine phosphorothioate
  modified_base 62: mod_base = OTHER; note = Thymine phosphorothioate
  modified_base 63: mod_base = OTHER; note = Adenine phosphorothioate
  modified_base 64: mod_base = OTHER; note = Thymine phosphorothioate

SEQ ID NO: 1235 - DNA, 68 bp, synthetic construct; identical to SEQ ID NO: 596
  source 1..68: mol_type = other DNA
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Guanosine phosphorothioate
  modified_base 62: mod_base = OTHER; note = Thymine phosphorothioate
  modified_base 63: mod_base = OTHER; note = Adenine phosphorothioate
  modified_base 64: mod_base = OTHER; note = Thymine phosphorothioate

SEQ ID NO: 1236 - DNA, 68 bp, synthetic construct; identical to SEQ ID NO: 597
  source 1..68: mol_type = other DNA
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Guanosine phosphorothioate
  modified_base 62: mod_base = OTHER; note = Thymine phosphorothioate
  modified_base 63: mod_base = OTHER; note = Adenine phosphorothioate
  modified_base 64: mod_base = OTHER; note = Thymine phosphorothioate

SEQ ID NO: 1237 - DNA, 68 bp, synthetic construct; identical to SEQ ID NO: 598
  source 1..68: mol_type = other DNA
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Guanosine phosphorothioate
  modified_base 62: mod_base = OTHER; note = Thymine phosphorothioate
  modified_base 63: mod_base = OTHER; note = Adenine phosphorothioate
  modified_base 64: mod_base = OTHER; note = Thymine phosphorothioate

SEQ ID NO: 1238 - DNA, 66 bp, synthetic construct; identical to SEQ ID NO: 599
  source 1..66: mol_type = other DNA
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Adenine phosphorothioate

SEQ ID NO: 1239 - DNA, 66 bp, synthetic construct; identical to SEQ ID NO: 600
  source 1..66: mol_type = other DNA
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Cytosine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Adenine phosphorothioate

SEQ ID NO: 1240 - DNA, 66 bp, synthetic construct; identical to SEQ ID NO: 601
  source 1..66: mol_type = other DNA
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Adenine phosphorothioate

SEQ ID NO: 1241 - DNA, 66 bp, synthetic construct; identical to SEQ ID NO: 602
  source 1..66: mol_type = other DNA
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Cytosine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Adenine phosphorothioate

SEQ ID NO: 1242 - DNA, 66 bp, synthetic construct; identical to SEQ ID NO: 603
  source 1..66: mol_type = other DNA
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Guanosine phosphorothioate
  modified_base 58: mod_base = OTHER; note = Thymine phosphorothioate
  modified_base 59: mod_base = OTHER; note = Guanosine phosphorothioate
  modified_base 60: mod_base = OTHER; note = Adenine phosphorothioate
  modified_base 61: mod_base = OTHER; note = Thymine phosphorothioate
  modified_base 62: mod_base = OTHER; note = Adenine phosphorothioate
  modified_base 63: mod_base = OTHER; note = Thymine phosphorothioate

SEQ ID NO: 1243 - DNA, 66 bp, synthetic construct; identical to SEQ ID NO: 604
  source 1..66: mol_type = other DNA
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Cytosine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Adenine phosphorothioate

SEQ ID NO: 1244 - DNA, 64 bp, synthetic construct; identical to SEQ ID NO: 605
  source 1..64: mol_type = other DNA
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Cytosine phosphorothioate
  modified_base 54: mod_base = OTHER; note = Adenine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Guanosine phosphorothioate
  modified_base 62: mod_base = OTHER; note = Thymine phosphorothioate

SEQ ID NO: 1245 - DNA, 64 bp, synthetic construct; identical to SEQ ID NO: 606
  source 1..64: mol_type = other DNA
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Guanosine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Cytosine phosphorothioate
  modified_base 62: mod_base = OTHER; note = Adenine phosphorothioate

SEQ ID NO: 1246 - DNA, 66 bp, synthetic construct; identical to SEQ ID NO: 607
  source 1..66: mol_type = other DNA
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Cytosine phosphorothioate
  modified_base 55: mod_base = OTHER; note = Adenine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Thymine phosphorothioate
  modified_base 62: mod_base = OTHER; note = Guanosine phosphorothioate
  modified_base 63: mod_base = OTHER; note = Adenine phosphorothioate

SEQ ID NO: 1247 - DNA, 66 bp, synthetic construct; identical to SEQ ID NO: 608
  source 1..66: mol_type = other DNA
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Cytosine phosphorothioate
  modified_base 55: mod_base = OTHER; note = Adenine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Thymine phosphorothioate
  modified_base 62: mod_base = OTHER; note = Guanosine phosphorothioate
  modified_base 63: mod_base = OTHER; note = Adenine phosphorothioate

SEQ ID NO: 1248 - DNA, 62 bp, synthetic construct; identical to SEQ ID NO: 609
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Guanosine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Thymine phosphorothioate

SEQ ID NO: 1249 - DNA, 62 bp, synthetic construct; identical to SEQ ID NO: 610
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Guanosine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Cytosine phosphorothioate

SEQ ID NO: 1250 - DNA, 62 bp, synthetic construct; identical to SEQ ID NO: 611
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Cytosine phosphorothioate
  modified_base 58: mod_base = OTHER; note = Guanosine phosphorothioate
  modified_base 59: mod_base = OTHER; note = Thymine phosphorothioate
  modified_base 60: mod_base = OTHER; note = Guanosine phosphorothioate
  modified_base 61: mod_base = OTHER; note = Thymine phosphorothioate

SEQ ID NO: 1251 - DNA, 62 bp, synthetic construct; identical to SEQ ID NO: 612
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Cytosine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Guanosine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Cytosine phosphorothioate
  modified_base 58: mod_base = OTHER; note = Guanosine phosphorothioate
  modified_base 59: mod_base = OTHER; note = Thymine phosphorothioate
  modified_base 60: mod_base = OTHER; note = Guanosine phosphorothioate
  modified_base 61: mod_base = OTHER; note = Thymine phosphorothioate

SEQ ID NO: 1252 - DNA, 62 bp, synthetic construct; identical to SEQ ID NO: 613
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Cytosine phosphorothioate
  modified_base 58: mod_base = OTHER; note = Guanosine phosphorothioate
  modified_base 59: mod_base = OTHER; note = Adenine phosphorothioate
  modified_base 60: mod_base = OTHER; note = Cytosine phosphorothioate
  modified_base 61: mod_base = OTHER; note = Guanosine phosphorothioate

SEQ ID NO: 1253 - DNA, 62 bp, synthetic construct; identical to SEQ ID NO: 614
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Adenine phosphorothioate
  modified_base 56: mod_base = OTHER; note = Guanosine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Thymine phosphorothioate

SEQ ID NO: 1254 - DNA, 62 bp, synthetic construct; identical to SEQ ID NO: 615
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Cytosine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Guanosine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Adenine phosphorothioate

SEQ ID NO: 1255 - DNA, 62 bp, synthetic construct; identical to SEQ ID NO: 616
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Guanosine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Cytosine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Guanosine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Adenine phosphorothioate

SEQ ID NO: 1256 - DNA, 62 bp, synthetic construct; identical to SEQ ID NO: 617
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Cytosine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Guanosine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Cytosine phosphorothioate

SEQ ID NO: 1257 - DNA, 62 bp, synthetic construct; identical to SEQ ID NO: 618
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Guanosine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Cytosine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Guanosine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Cytosine phosphorothioate

SEQ ID NO: 1258 - DNA, 68 bp, synthetic construct; identical to SEQ ID NO: 619
  source 1..68: mol_type = other DNA
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Guanosine phosphorothioate
  modified_base 62: mod_base = OTHER; note = Thymine phosphorothioate
  modified_base 63: mod_base = OTHER; note = Adenine phosphorothioate
  modified_base 64: mod_base = OTHER; note = Thymine phosphorothioate

SEQ ID NO: 1259 - DNA, 68 bp, synthetic construct; identical to SEQ ID NO: 620
  source 1..68: mol_type = other DNA
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Guanosine phosphorothioate
  modified_base 62: mod_base = OTHER; note = Thymine phosphorothioate
  modified_base 63: mod_base = OTHER; note = Adenine phosphorothioate
  modified_base 64: mod_base = OTHER; note = Thymine phosphorothioate

SEQ ID NO: 1260 - DNA, 68 bp, synthetic construct; identical to SEQ ID NO: 621
  source 1..68: mol_type = other DNA
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Guanosine phosphorothioate
  modified_base 62: mod_base = OTHER; note = Thymine phosphorothioate
  modified_base 63: mod_base = OTHER; note = Adenine phosphorothioate
  modified_base 64: mod_base = OTHER; note = Thymine phosphorothioate

SEQ ID NO: 1261 - DNA, 68 bp, synthetic construct; identical to SEQ ID NO: 622
  source 1..68: mol_type = other DNA
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Guanosine phosphorothioate
  modified_base 62: mod_base = OTHER; note = Thymine phosphorothioate
  modified_base 63: mod_base = OTHER; note = Adenine phosphorothioate
  modified_base 64: mod_base = OTHER; note = Thymine phosphorothioate

SEQ ID NO: 1262 - DNA, 66 bp, synthetic construct; identical to SEQ ID NO: 623
  source 1..66: mol_type = other DNA
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Cytosine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Cytosine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Adenine phosphorothioate

SEQ ID NO: 1263 - DNA, 66 bp, synthetic construct; identical to SEQ ID NO: 624
  source 1..66: mol_type = other DNA
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Cytosine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Cytosine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Adenine phosphorothioate

SEQ ID NO: 1264 - DNA, 66 bp, synthetic construct; identical to SEQ ID NO: 625
  source 1..66: mol_type = other DNA
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Cytosine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Guanosine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Cytosine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Cytosine phosphorothioate

SEQ ID NO: 1265 - DNA, 68 bp, synthetic construct; identical to SEQ ID NO: 626
  source 1..68: mol_type = other DNA
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Guanosine phosphorothioate
  modified_base 62: mod_base = OTHER; note = Adenine phosphorothioate
  modified_base 63: mod_base = OTHER; note = Thymine phosphorothioate
  modified_base 64: mod_base = OTHER; note = Adenine phosphorothioate

SEQ ID NO: 1266 - DNA, 66 bp, synthetic construct; identical to SEQ ID NO: 627
  source 1..66: mol_type = other DNA
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Cytosine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Adenine phosphorothioate

SEQ ID NO: 1267 - DNA, 66 bp, synthetic construct; identical to SEQ ID NO: 628
  source 1..66: mol_type = other DNA
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Guanosine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Cytosine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Adenine phosphorothioate

SEQ ID NO: 1268 - DNA, 66 bp, synthetic construct; identical to SEQ ID NO: 629
  source 1..66: mol_type = other DNA
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Cytosine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Adenine phosphorothioate

SEQ ID NO: 1269 - DNA, 64 bp, synthetic construct; identical to SEQ ID NO: 630
  source 1..64: mol_type = other DNA
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Cytosine phosphorothioate
  modified_base 54: mod_base = OTHER; note = Adenine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Guanosine phosphorothioate
  modified_base 62: mod_base = OTHER; note = Thymine phosphorothioate

SEQ ID NO: 1270 - DNA, 64 bp, synthetic construct; identical to SEQ ID NO: 631
  source 1..64: mol_type = other DNA
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Cytosine phosphorothioate
  modified_base 54: mod_base = OTHER; note = Adenine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Guanosine phosphorothioate
  modified_base 62: mod_base = OTHER; note = Thymine phosphorothioate

SEQ ID NO: 1271 - DNA, 64 bp, synthetic construct; identical to SEQ ID NO: 632
  source 1..64: mol_type = other DNA
  modified_base 47: mod_base = OTHER; note = Thymine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Guanosine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Cytosine phosphorothioate
  modified_base 54: mod_base = OTHER; note = Adenine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Guanosine phosphorothioate
  modified_base 62: mod_base = OTHER; note = Thymine phosphorothioate

SEQ ID NO: 1272 - DNA, 62 bp, synthetic construct; identical to SEQ ID NO: 633
  source 1..62: mol_type = other DNA
  modified_base 46: mod_base = OTHER; note = Cytosine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Guanosine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Cytosine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Guanosine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Cytosine phosphorothioate

SEQ ID NO: 1273 - DNA, 62 bp, synthetic construct; identical to SEQ ID NO: 634
  source 1..62: mol_type = other DNA
  modified_base 46: mod_base = OTHER; note = Adenine phosphorothioate
  modified_base 47: mod_base = OTHER; note = Thymine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Cytosine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Guanosine phosphorothioate
  modified_base 56: mod_base = OTHER; note = Thymine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Adenine phosphorothioate
  modified_base 60: mod_base = OTHER; note = Thymine phosphorothioate
  modified_base 61: mod_base = OTHER; note = Adenine phosphorothioate

SEQ ID NO: 1274 - DNA, 62 bp, synthetic construct; identical to SEQ ID NO: 635
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Cytosine phosphorothioate
  modified_base 58: mod_base = OTHER; note = Guanosine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Thymine phosphorothioate

SEQ ID NO: 1275 - DNA, 62 bp, synthetic construct; identical to SEQ ID NO: 636
  source 1..62: mol_type = other DNA
  modified_base 46: mod_base = OTHER; note = Adenine phosphorothioate
  modified_base 47: mod_base = OTHER; note = Cytosine phosphorothioate
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Guanosine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Cytosine phosphorothioate
  modified_base 58: mod_base = OTHER; note = Guanosine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Thymine phosphorothioate

SEQ ID NO: 1276 - DNA, 62 bp, synthetic construct; identical to SEQ ID NO: 637
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Cytosine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Cytosine phosphorothioate
  modified_base 58: mod_base = OTHER; note = Guanosine phosphorothioate
  modified_base 59: mod_base = OTHER; note = Thymine phosphorothioate
  modified_base 60: mod_base = OTHER; note = Guanosine phosphorothioate
  modified_base 61: mod_base = OTHER; note = Thymine phosphorothioate

SEQ ID NO: 1277 - DNA, 68 bp, synthetic construct; identical to SEQ ID NO: 638
  source 1..68: mol_type = other DNA
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Cytosine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Guanosine phosphorothioate
  modified_base 62: mod_base = OTHER; note = Thymine phosphorothioate
  modified_base 63: mod_base = OTHER; note = Adenine phosphorothioate
  modified_base 64: mod_base = OTHER; note = Thymine phosphorothioate

SEQ ID NO: 1278 - DNA, 68 bp, synthetic construct; identical to SEQ ID NO: 639
  source 1..68: mol_type = other DNA
  modified_base 49: mod_base = OTHER; note = Adenine phosphorothioate
  modified_base 50: mod_base = OTHER; note = Cytosine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Guanosine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Guanosine phosphorothioate
  modified_base 62: mod_base = OTHER; note = Thymine phosphorothioate
  modified_base 63: mod_base = OTHER; note = Adenine phosphorothioate
  modified_base 64: mod_base = OTHER; note = Thymine phosphorothioate

SEQ ID NO: 1279 - DNA, 68 bp, synthetic construct; identical to SEQ ID NO: 640
  source 1..68: mol_type = other DNA
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Cytosine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Guanosine phosphorothioate
  modified_base 62: mod_base = OTHER; note = Thymine phosphorothioate
  modified_base 63: mod_base = OTHER; note = Adenine phosphorothioate
  modified_base 64: mod_base = OTHER; note = Thymine phosphorothioate

SEQ ID NO: 1280 - DNA, 68 bp, synthetic construct; identical to SEQ ID NO: 641
  source 1..68: mol_type = other DNA
  modified_base 49: mod_base = OTHER; note = Adenine phosphorothioate
  modified_base 50: mod_base = OTHER; note = Cytosine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Guanosine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Guanosine phosphorothioate
  modified_base 62: mod_base = OTHER; note = Thymine phosphorothioate
  modified_base 63: mod_base = OTHER; note = Adenine phosphorothioate
  modified_base 64: mod_base = OTHER; note = Thymine phosphorothioate

SEQ ID NO: 1281 - DNA, 66 bp, synthetic construct; identical to SEQ ID NO: 642
  source 1..66: mol_type = other DNA
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Cytosine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Cytosine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Adenine phosphorothioate

SEQ ID NO: 1282 - DNA, 66 bp, synthetic construct; identical to SEQ ID NO: 643
  source 1..66: mol_type = other DNA
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Cytosine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Cytosine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Adenine phosphorothioate

SEQ ID NO: 1283 - DNA, 66 bp, synthetic construct; identical to SEQ ID NO: 644
  source 1..66: mol_type = other DNA
  modified_base 48: mod_base = OTHER; note = Cytosine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Guanosine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Cytosine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Adenine phosphorothioate

SEQ ID NO: 1284 - DNA, 66 bp, synthetic construct; identical to SEQ ID NO: 645
  source 1..66: mol_type = other DNA
  modified_base 48: mod_base = OTHER; note = Adenine phosphorothioate
  modified_base 49: mod_base = OTHER; note = Thymine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Adenine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Adenine phosphorothioate

SEQ ID NO: 1285 - DNA, 70 bp, synthetic construct; identical to SEQ ID NO: 646
  source 1..70: mol_type = other DNA
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Cytosine phosphorothioate
  modified_base 55: mod_base = OTHER; note = Adenine phosphorothioate
  modified_base 56: mod_base = OTHER; note = Thymine phosphorothioate
  modified_base 57: mod_base = OTHER; note = Guanosine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Guanosine phosphorothioate
  modified_base 64: mod_base = OTHER; note = Thymine phosphorothioate
  modified_base 65: mod_base = OTHER; note = Adenine phosphorothioate

SEQ ID NO: 1286 - DNA, 62 bp, synthetic construct; identical to SEQ ID NO: 647
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Cytosine phosphorothioate
  modified_base 56: mod_base = OTHER; note = Guanosine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Thymine phosphorothioate

SEQ ID NO: 1287 - DNA, 62 bp, synthetic construct; identical to SEQ ID NO: 648
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Cytosine phosphorothioate
  modified_base 56: mod_base = OTHER; note = Guanosine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Cytosine phosphorothioate
  modified_base 61: mod_base = OTHER; note = Adenine phosphorothioate

SEQ ID NO: 1288 - DNA, 62 bp, synthetic construct; identical to SEQ ID NO: 649
  source 1..62: mol_type = other DNA
  modified_base 46: mod_base = OTHER; note = Thymine phosphorothioate
  modified_base 47: mod_base = OTHER; note = Adenine phosphorothioate
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Adenine phosphorothioate
  modified_base 54: mod_base = OTHER; note = Thymine phosphorothioate
  modified_base 55: mod_base = OTHER; note = Cytosine phosphorothioate
  modified_base 56: mod_base = OTHER; note = Guanosine phosphorothioate
  modified_base 57: mod_base = OTHER; note = Thymine phosphorothioate
  modified_base 58: mod_base = OTHER; note = Adenine phosphorothioate
  modified_base 59: mod_base = OTHER; note = Thymine phosphorothioate
  modified_base 60: mod_base = OTHER; note = Adenine phosphorothioate
  modified_base 61: mod_base = OTHER; note = Cytosine phosphorothioate

SEQ ID NO: 1289 - DNA, 66 bp, synthetic construct; identical to SEQ ID NO: 650
  source 1..66: mol_type = other DNA
  modified_base 48: mod_base = OTHER; note = Adenine phosphorothioate
  modified_base 49: mod_base = OTHER; note = Cytosine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Cytosine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Adenine phosphorothioate

SEQ ID NO: 1290 - DNA, 66 bp, synthetic construct; identical to SEQ ID NO: 651
  source 1..66: mol_type = other DNA
  modified_base 48: mod_base = OTHER; note = Adenine phosphorothioate
  modified_base 49: mod_base = OTHER; note = Cytosine phosphorothioate
  modified_base 50: mod_base = OTHER; note = Adenine phosphorothioate
  modified_base 51: mod_base = OTHER; note = Thymine phosphorothioate
  modified_base 52: mod_base = OTHER; note = Adenine phosphorothioate
  modified_base 53: mod_base = OTHER; note = Thymine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Cytosine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Adenine phosphorothioate

SEQ ID NO: 1291 - DNA, 66 bp, synthetic construct; identical to SEQ ID NO: 652
  source 1..66: mol_type = other DNA
  modified_base 48: mod_base = OTHER; note = Thymine phosphorothioate
  modified_base 49: mod_base = OTHER; note = Adenine phosphorothioate
  modified_base 50: mod_base = OTHER; note = Thymine phosphorothioate
  modified_base 51: mod_base = OTHER; note = Adenine phosphorothioate
  modified_base 52: mod_base = OTHER; note = Thymine phosphorothioate
  modified_base 53: mod_base = OTHER; note = Guanosine phosphorothioate
  modified_base 54: mod_base = OTHER; note = Adenine phosphorothioate
  modified_base 55: mod_base = OTHER; note = Thymine phosphorothioate
  modified_base 56: mod_base = OTHER; note = Cytosine phosphorothioate
  modified_base 57: mod_base = OTHER; note = Adenine phosphorothioate
  modified_base 58: mod_base = OTHER; note = Thymine phosphorothioate
  modified_base 59: mod_base = OTHER; note = Guanosine phosphorothioate
  modified_base 60: mod_base = OTHER; note = Thymine phosphorothioate
  modified_base 61: mod_base = OTHER; note = Adenine phosphorothioate
  modified_base 62: mod_base = OTHER; note = Thymine phosphorothioate
  modified_base 63: mod_base = OTHER; note = Adenine phosphorothioate

SEQ ID NO: 1292 - DNA, 52 bp, synthetic construct
  source 1..52: mol_type = other DNA
tatatattattttattttaatcgagtctttttgactcgatatacaatatata

SEQ ID NO: 1293 - DNA, 52 bp, synthetic construct
  source 1..52: mol_type = other DNA
gatatattattttattttaatcgagtctttttgactcgatatacaatatatc

SEQ ID NO: 1294 - DNA, 52 bp, synthetic construct
  source 1..52: mol_type = other DNA
gatatatcattttattttaatcgagtctttttgactcgatatacgatatatc

SEQ ID NO: 1295 - DNA, 52 bp, synthetic construct
  source 1..52: mol_type = other DNA
gatatgtcattttattttaatcgagtctttttgactcgatatacgacatatc

SEQ ID NO: 1296 - DNA, 52 bp, synthetic construct
  source 1..52: mol_type = other DNA
gtgatgtcattttattttaatcgagtctttttgactcgatatacgacatcac

SEQ ID NO: 1297 - DNA, 52 bp, synthetic construct
  source 1..52: mol_type = other DNA
tatatattattttattttatgcgagtctttttgactcgcagcccaatatata

SEQ ID NO: 1298 - DNA, 52 bp, synthetic construct
  source 1..52: mol_type = other DNA
gatatattattttattttatgcgagtctttttgactcgcagcccaatatatc

SEQ ID NO: 1299 - DNA, 52 bp, synthetic construct
  source 1..52: mol_type = other DNA
gatatatcattttattttatgcgagtctttttgactcgcagcccgatatatc

SEQ ID NO: 1300 - DNA, 52 bp, synthetic construct
  source 1..52: mol_type = other DNA
gatatgtcattttattttatgcgagtctttttgactcgcagcccgacatatc

SEQ ID NO: 1301 - DNA, 52 bp, synthetic construct
  source 1..52: mol_type = other DNA
gtgatgtcattttattttatgcgagtctttttgactcgcagcccgacatcac

SEQ ID NO: 1302 - DNA, 47 bp, synthetic construct
  source 1..47: mol_type = other DNA
tatatattattttattttagtatatcggactcgatatacaatatata

SEQ ID NO: 1303 - DNA, 47 bp, synthetic construct
  source 1..47: mol_type = other DNA
gatatattattttattttagtatatcggactcgatatacaatatatc

SEQ ID NO: 1304 - DNA, 47 bp, synthetic construct
  source 1..47: mol_type = other DNA
gatatatcattttattttagtatatcggactcgatatacgatatatc

SEQ ID NO: 1305 - DNA, 47 bp, synthetic construct
  source 1..47: mol_type = other DNA
gatatgtcattttattttagtatatcggactcgatatacgacatatc

SEQ ID NO: 1306 - DNA, 47 bp, synthetic construct
  source 1..47: mol_type = other DNA
gtgatgtcattttattttagtatatcggactcgatatacgacatcac

SEQ ID NO: 1307 - DNA, 47 bp, synthetic construct
  source 1..47: mol_type = other DNA
tatatattattttattttagggctgcggactcgcagcccaatatata

SEQ ID NO: 1308 - DNA, 47 bp, synthetic construct
  source 1..47: mol_type = other DNA
gatatattattttattttagggctgcggactcgcagcccaatatatc

SEQ ID NO: 1309 - DNA, 47 bp, synthetic construct
  source 1..47: mol_type = other DNA
gatatatcattttattttagggctgcggactcgcagcccgatatatc

SEQ ID NO: 1310 - DNA, 47 bp, synthetic construct
  source 1..47: mol_type = other DNA
gatatgtcattttattttagggctgcggactcgcagcccgacatatc

SEQ ID NO: 1311 - DNA, 47 bp, synthetic construct
  source 1..47: mol_type = other DNA
gtgatgtcattttattttagggctgcggactcgcagcccgacatcac

SEQ ID NO: 1312 - DNA, 41 bp, synthetic construct
  source 1..41: mol_type = other DNA
tatatatattattactatatggactcgcatatagatatata

SEQ ID NO: 1313 - DNA, 41 bp, synthetic construct
  source 1..41: mol_type = other DNA
gatatatattattactatatggactcgcatatagatatatc

SEQ ID NO: 1314 - DNA, 41 bp, synthetic construct
  source 1..41: mol_type = other DNA
gatatacattattactatatggactcgcatataggtatatc

SEQ ID NO: 1315 - DNA, 41 bp, synthetic construct
  source 1..41: mol_type = other DNA
gatatccattattactatatggactcgcatatagggatatc

SEQ ID NO: 1316 - DNA, 41 bp, synthetic construct
  source 1..41: mol_type = other DNA
gtgatacattattactatatggactcgcatataggtatcac

SEQ ID NO: 1317 - DNA, 41 bp, synthetic construct
  source 1..41: mol_type = other DNA
tatatattttatttcgggctggactcgcagcccgatatata

SEQ ID NO: 1318 - DNA, 41 bp, synthetic construct
  source 1..41: mol_type = other DNA
gatatatattattacgggctggactcgcagcccgatatatc

SEQ ID NO: 1319 - DNA, 41 bp, synthetic construct
  source 1..41: mol_type = other DNA
gatatacattattacgggctggactcgcagcccggtatatc

SEQ ID NO: 1320 - DNA, 41 bp, synthetic construct
  source 1..41: mol_type = other DNA
gatatccattattacgggctggactcgcagcccgggatatc

SEQ ID NO: 1321 - DNA, 41 bp, synthetic construct
  source 1..41: mol_type = other DNA
gtgatacattattacgggctggactcgcagcccggtatcac

SEQ ID NO: 1322 - DNA, 58 bp, synthetic construct
  source 1..58: mol_type = other DNA
tatatattttatttctatatgtttatttcgagtcttttgactcgcatatagatatata

SEQ ID NO: 1323 - DNA, 58 bp, synthetic construct
  source 1..58: mol_type = other DNA
gatatatattattactatatgattattacgagtcttttgactcgcatatagatatatc

SEQ ID NO: 1324 - DNA, 58 bp, synthetic construct
  source 1..58: mol_type = other DNA
gatatacattattactatatgattattacgagtcttttgactcgcatataggtatatc

SEQ ID NO: 1325 - DNA, 58 bp, synthetic construct
  source 1..58: mol_type = other DNA
gatatccattattactatatgattattacgagtcttttgactcgcatatagggatatc

SEQ ID NO: 1326 - DNA, 58 bp, synthetic construct
  source 1..58: mol_type = other DNA
gtgatacattattactatatgattattacgagtcttttgactcgcatataggtatcac

SEQ ID NO: 1327 - DNA, 58 bp, synthetic construct
  source 1..58: mol_type = other DNA
tatatatattattacgggctgattattacgagtcttttgactcgcagcccgatatata

SEQ ID NO: 1328 - DNA, 58 bp, synthetic construct
  source 1..58: mol_type = other DNA
gatatatattattacgggctgattattacgagtcttttgactcgcagcccgatatatc

SEQ ID NO: 1329 - DNA, 58 bp, synthetic construct
  source 1..58: mol_type = other DNA
gatatacattattacgggctgattattacgagtcttttgactcgcagcccggtatatc

SEQ ID NO: 1330 - DNA, 58 bp, synthetic construct
  source 1..58: mol_type = other DNA
gatatccattattacgggctgattattacgagtcttttgactcgcagcccgggatatc

SEQ ID NO: 1331 - DNA, 58 bp, synthetic construct
  source 1..58: mol_type = other DNA
gtgatacattattacgggctgattattacgagtcttttgactcgcagcccggtatcac

SEQ ID NO: 1332 - DNA, 39 bp, synthetic construct
  source 1..39: mol_type = other DNA
tatatatttatttcatatcgactcgcagatatgtatata

SEQ ID NO: 1333 - DNA, 39 bp, synthetic construct
  source 1..39: mol_type = other DNA
gatatcattattacatatcgactcgcagatatggatatc

SEQ ID NO: 1334 - DNA, 39 bp, synthetic construct
  source 1..39: mol_type = other DNA
gtgatcattattacatatcgactcgcagatatggatcac

SEQ ID NO: 1335 - DNA, 39 bp, synthetic construct
  source 1..39: mol_type = other DNA
gtgtgcattattacatatcgactcgcagatatggcacac

SEQ ID NO: 1336 - DNA, 39 bp, synthetic construct
  source 1..39: mol_type = other DNA
gatatcattattaccgggcgactcgcagcccgggatatc

SEQ ID NO: 1337 - DNA, 39 bp, synthetic construct
  source 1..39: mol_type = other DNA
gtgatcattattaccgggcgactcgcagcccgggatcac

SEQ ID NO: 1338 - DNA, 39 bp, synthetic construct
  source 1..39: mol_type = other DNA
gtgtgcattattaccgggcgactcgcagcccgggcacac

SEQ ID NO: 1339 - DNA, 58 bp, synthetic construct
  source 1..58: mol_type = other DNA
tatatatttatttcatatctttattttgcgagtcttttgactcgcagatatgtatata

SEQ ID NO: 1340 - DNA, 58 bp, synthetic construct
  source 1..58: mol_type = other DNA
gatatcattattacatatcattattatgcgagtcttttgactcgcagatatggatatc

SEQ ID NO: 1341 - DNA, 58 bp, synthetic construct
  source 1..58: mol_type = other DNA
gtgatcattattacatatcattattatgcgagtcttttgactcgcagatatggatcac

SEQ ID NO: 1342 - DNA, 58 bp, synthetic construct
  source 1..58: mol_type = other DNA
gtgtgcattattacatatcattattatgcgagtcttttgactcgcagatatggcacac

SEQ ID NO: 1343 - DNA, 58 bp, synthetic construct
  source 1..58: mol_type = other DNA
gatatcattattaccgggcattattatgcgagtcttttgactcgcagcccgggatatc

SEQ ID NO: 1344 - DNA, 58 bp, synthetic construct
  source 1..58: mol_type = other DNA
gtgatcattattaccgggcattattatgcgagtcttttgactcgcagcccgggatcac

SEQ ID NO: 1345 - DNA, 58 bp, synthetic construct
  source 1..58: mol_type = other DNA
gtgtgcattattaccgggcattattatgcgagtcttttgactcgcagcccgggcacac

SEQ ID NO: 1346 - DNA, 37 bp, synthetic construct
  source 1..37: mol_type = other DNA
gtatgattattacacaggactcgcagcctgtgcatac

SEQ ID NO: 1347 - DNA, 37 bp, synthetic construct
  source 1..37: mol_type = other DNA
gtgtgattattacacaggactcgcagcctgtgcacac

SEQ ID NO: 1348 - DNA, 37 bp, synthetic construct
  source 1..37: mol_type = other DNA
gtatgattattacccgggactcgcagcccgggcatac

SEQ ID NO: 1349 - DNA, 37 bp, synthetic construct
  source 1..37: mol_type = other DNA
gtgtgattattacccgggactcgcagcccgggcacac

SEQ ID NO: 1350 - DNA, 65 bp, synthetic construct
  source 1..65: mol_type = other DNA
gtatgattattacacagattattagctgcattattagagtcttttgactcgcagcctgtgcatac

SEQ ID NO: 1351 - DNA, 65 bp, synthetic construct
  source 1..65: mol_type = other DNA
gtgtgattattacacagattattagctgcattattagagtcttttgactcgcagcctgtgcacac

SEQ ID NO: 1352 - DNA, 65 bp, synthetic construct
  source 1..65: mol_type = other DNA
tatatattattacccggattattagctgcattattagagtcttttgactcgcagcccgggatata

SEQ ID NO: 1353 - DNA, 65 bp, synthetic construct
  source 1..65: mol_type = other DNA
gatatattattacccggattattagctgcattattagagtcttttgactcgcagcccgggatatc

SEQ ID NO: 1354 - DNA, 65 bp, synthetic construct
  source 1..65: mol_type = other DNA
gtatgattattacccggattattagctgcattattagagtcttttgactcgcagcccgggcatac

SEQ ID NO: 1355 - DNA, 65 bp, synthetic construct
  source 1..65: mol_type = other DNA
gtgtgattattacccggattattagctgcattattagagtcttttgactcgcagcccgggcacac

SEQ ID NO: 1356 - DNA, 69 bp, synthetic construct
  source 1..69: mol_type = other DNA
gactcgatatacaatatatagcgcgcgcaataagcgcgcattattagctatataattattattgtatat

SEQ ID NO: 1357 - DNA, 69 bp, synthetic construct
  source 1..69: mol_type = other DNA
gactcgatatacaatatatcgcgcgcgcaataagcgcgcattattagcgatataattattattgtatat

SEQ ID NO: 1358 - DNA, 69 bp, synthetic construct
  source 1..69: mol_type = other DNA
gactcgatatacgatatatcgcgcgcgcaataagcgcgcattattagcgatataattattatcgtatat

SEQ ID NO: 1359 - DNA, 69 bp, synthetic construct
  source 1..69: mol_type = other DNA
gactcgatatacgacatatcgcgcgcgcaataagcgcgcattattagcgatatgattattatcgtatat

SEQ ID NO: 1360 - DNA, 69 bp, synthetic construct
  source 1..69: mol_type = other DNA
gactcgatatacgacatcacgcgcgcgcaataagcgcgcattattagcgtgatgattattatcgtatat

SEQ ID NO: 1361 - DNA, 69 bp, synthetic construct
  source 1..69: mol_type = other DNA
gactcgcagcccaatatatagcgcgcgcaataagcgcgcattattagctatataattattattgggctg

SEQ ID NO: 1362 - DNA, 69 bp, synthetic construct
  source 1..69: mol_type = other DNA
gactcgcagcccaatatatcgcgcgcgcaataagcgcgcattattagcgatataattattattgggctg

SEQ ID NO: 1363 - DNA, 69 bp, synthetic construct
  source 1..69: mol_type = other DNA
gactcgcagcccgatatatcgcgcgcgcaataagcgcgcattattagcgatataattattatcgggctg

SEQ ID NO: 1364 - DNA, 69 bp, synthetic construct
  source 1..69: mol_type = other DNA
gactcgcagcccgacatatcgcgcgcgcaataagcgcgcattattagcgatatgattattatcgggctg

SEQ ID NO: 1365 - DNA, 69 bp, synthetic construct
  source 1..69: mol_type = other DNA
gactcgcagcccgacatcacgcgcgcgcaataagcgcgcattattagcgtgatgattattatcgggctg

SEQ ID NO: 1366 - DNA, 82 bp, synthetic construct
  source 1..82: mol_type = other DNA
gactcgatatacaatatatagcgcgcgcaataagcgcgcattattagctatataattattattgtatattattaatcgagtc

SEQ ID NO: 1367 - DNA, 82 bp, synthetic construct
  source 1..82: mol_type = other DNA
gactcgatatacaatatatcgcgcgcgcaataagcgcgcattattagcgatataattattattgtatattattaatcgagtc

SEQ ID NO: 1368 - DNA, 82 bp, synthetic construct
  source 1..82: mol_type = other DNA
gactcgatatacgatatatcgcgcgcgcaataagcgcgcattattagcgatataattattatcgtatattattaatcgagtc

SEQ ID NO: 1369 - DNA, 82 bp, synthetic construct
  source 1..82: mol_type = other DNA
gactcgatatacgacatatcgcgcgcgcaataagcgcgcattattagcgatatgattattatcgtatattattaatcgagtc

SEQ ID NO: 1370 - DNA, 82 bp, synthetic construct
  source 1..82: mol_type = other DNA
gactcgatatacgacatcacgcgcgcgcaataagcgcgcattattagcgtgatgattattatcgtatattattaatcgagtc

SEQ ID NO: 1371 - DNA, 82 bp, synthetic construct
  source 1..82: mol_type = other DNA
gactcgcagcccaatatatagcgcgcgcaataagcgcgcattattagctatataattattattgggcattattatgcgagtc

SEQ ID NO: 1372 - DNA, 82 bp, synthetic construct
  source 1..82: mol_type = other DNA
gactcgcagcccaatatatcgcgcgcgcaataagcgcgcattattagcgatataattattattgggcattattatgcgagtc

SEQ ID NO: 1373 - DNA, 82 bp, synthetic construct
  source 1..82: mol_type = other DNA
gactcgcagcccgatatatcgcgcgcgcaataagcgcgcattattagcgatataattattatcgggcattattatgcgagtc

SEQ ID NO: 1374 - DNA, 82 bp, synthetic construct
  source 1..82: mol_type = other DNA
gactcgcagcccgacatatcgcgcgcgcaataagcgcgcattattagcgatatgattattatcgggcattattatgcgagtc

SEQ ID NO: 1375 - DNA, 82 bp, synthetic construct
  source 1..82: mol_type = other DNA
gactcgcagcccgacatcacgcgcgcgcaataagcgcgcattattagcgtgatgattattatcgggcattattatgcgagtc

SEQ ID NO: 1376 - DNA, 67 bp, synthetic construct
  source 1..67: mol_type = other DNA
gactcgcatatagatatatagcgcgcgcaataagcgcgcattattagctatatattattaatctata

SEQ ID NO: 1377 - DNA, 67 bp, synthetic construct
  source 1..67: mol_type = other DNA
gactcgcatatagatatatcgcgcgcgcaataagcgcgcattattagcgatatattattaatctata

SEQ ID NO: 1378 - DNA, 67 bp, synthetic construct
  source 1..67: mol_type = other DNA
gactcgcatataggtatatcgcgcgcgcaataagcgcgcattattagcgatatattattaacctata

SEQ ID NO: 1379 - DNA, 67 bp, synthetic construct
  source 1..67: mol_type = other DNA
gactcgcatatagggatatcgcgcgcgcaataagcgcgcattattagcgatatattattaccctata

SEQ ID NO: 1380 - DNA, 67 bp, synthetic construct
  source 1..67: mol_type = other DNA
gactcgcatataggtatcacgcgcgcgcaataagcgcgcattattagcgtgatattattaacctata

SEQ ID NO: 1381 - DNA, 67 bp, synthetic construct
  source 1..67: mol_type = other DNA
gactcgcagcccgatatatagcgcgcgcaataagcgcgcattattagctatatattattaatcgggc

SEQ ID NO: 1382 - DNA, 67 bp, synthetic construct
  source 1..67: mol_type = other DNA
gactcgcagcccgatatatcgcgcgcgcaataagcgcgcattattagcgatatattattaatcgggc

SEQ ID NO: 1383 - DNA, 67 bp, synthetic construct
  source 1..67: mol_type = other DNA
gactcgcagcccggtatatcgcgcgcgcaataagcgcgcattattagcgatatattattaaccgggc

SEQ ID NO: 1384 - DNA, 67 bp, synthetic construct
  source 1..67: mol_type = other DNA
gactcgcagcccgggatatcgcgcgcgcaataagcgcgcattattagcgatatattattacccgggc

SEQ ID NO: 1385 - DNA, 67 bp, synthetic construct
  source 1..67: mol_type = other DNA
gactcgcagcccggtatcacgcgcgcgcaataagcgcgcattattagcgtgatattattaaccgggc

SEQ ID NO: 1386 - DNA, 81 bp, synthetic construct
  source 1..81: mol_type = other DNA
gactcgcatatagatatatagcgcgcgcaataagcgcgcattattagctatatattattaatctataattattatgcgagt

SEQ ID NO: 1387 - DNA, 81 bp, synthetic construct
  source 1..81: mol_type = other DNA
gactcgcatatagatatatcgcgcgcgcaataagcgcgcattattagcgatatattattaatctataattattatgcgagt

SEQ ID NO: 1388 - DNA, 81 bp, synthetic construct
  source 1..81: mol_type = other DNA
gactcgcatataggtatatcgcgcgcgcaataagcgcgcattattagcgatatattattaacctataattattatgcgagt

SEQ ID NO: 1389 - DNA, 81 bp, synthetic construct
  source 1..81: mol_type = other DNA
gactcgcatatagggatatcgcgcgcgcaataagcgcgcattattagcgatatattattaccctataattattatgcgagt

SEQ ID NO: 1390 - DNA, 81 bp, synthetic construct
  source 1..81: mol_type = other DNA
gactcgcatataggtatcacgcgcgcgcaataagcgcgcattattagcgtgatattattaacctataattattatgcgagt

SEQ ID NO: 1391 - DNA, 81 bp, synthetic construct
  source 1..81: mol_type = other DNA
gactcgcagcccgatatatagcgcgcgcaataagcgcgcattattagctatatattattaatcgggcattattatgcgagt

SEQ ID NO: 1392 - DNA, 81 bp, synthetic construct
  source 1..81: mol_type = other DNA
gactcgcagcccgatatatcgcgcgcgcaataagcgcgcattattagcgatatattattaatcgggcattattatgcgagt

SEQ ID NO: 1393 - DNA, 81 bp, synthetic construct
  source 1..81: mol_type = other DNA
gactcgcagcccggtatatcgcgcgcgcaataagcgcgcattattagcgatatattattaaccgggcattattatgcgagt

SEQ ID NO: 1394 - DNA, 81 bp, synthetic construct
  source 1..81: mol_type = other DNA
gactcgcagcccgggatatcgcgcgcgcaataagcgcgcattattagcgatatattattacccgggcattattatgcgagt

SEQ ID NO: 1395 - DNA, 81 bp, synthetic construct
  source 1..81: mol_type = other DNA
gactcgcagcccggtatcacgcgcgcgcaataagcgcgcattattagcgtgatattattaaccgggcattattatgcgagt

SEQ ID NO: 1396 - DNA, 65 bp, synthetic construct
  source 1..65: mol_type = other DNA
gactcgcagatatgtatatagcgcgcgcaataagcgcgcattattagctataattattatacata

SEQ ID NO: 1397 - DNA, 65 bp, synthetic construct
  source 1..65: mol_type = other DNA
gactcgcagatatgtatatcgcgcgcgcaataagcgcgcattattagcgataattattatacata

SEQ ID NO: 1398 - DNA, 65 bp, synthetic construct
  source 1..65: mol_type = other DNA
gactcgcagatatggatatcgcgcgcgcaataagcgcgcattattagcgataattattatccata

SEQ ID NO: 1399 - DNA, 65 bp, synthetic construct
  source 1..65: mol_type = other DNA
gactcgcagatatggatcacgcgcgcgcaataagcgcgcattattagcgtgaattattatccata

SEQ ID NO: 1400 - DNA, 65 bp, synthetic construct
  source 1..65: mol_type = other DNA
gactcgcagatatggcacacgcgcgcgcaataagcgcgcattattagcgtgtattattagccata

SEQ ID NO: 1401 - DNA, 65 bp, synthetic construct
  source 1..65: mol_type = other DNA
gactcgcagcccggtatatagcgcgcgcaataagcgcgcattattagctataattattataccgg

SEQ ID NO: 1402 - DNA, 65 bp, synthetic construct
  source 1..65: mol_type = other DNA
gactcgcagcccggtatatcgcgcgcgcaataagcgcgcattattagcgataattattataccgg

SEQ ID NO: 1403 - DNA, 65 bp, synthetic construct
  source 1..65: mol_type = other DNA
gactcgcagcccgggatatcgcgcgcgcaataagcgcgcattattagcgataattattatcccgg

SEQ ID NO: 1404 - DNA, 65 bp, synthetic construct
  source 1..65: mol_type = other DNA
gactcgcagcccgggatcacgcgcgcgcaataagcgcgcattattagcgtgaattattatcccgg

SEQ ID NO: 1405 - DNA, 65 bp, synthetic construct
  source 1..65: mol_type = other DNA
gactcgcagcccgggcacacgcgcgcgcaataagcgcgcattattagcgtgtattattagcccgg

SEQ ID NO: 1406 - DNA, 63 bp, synthetic construct
  source 1..63: mol_type = other DNA
gactcgcagcctgtgatatagcgcgcgcaataagcgcgcattattagctatattattaatcac

SEQ ID NO: 1407 - DNA, 63 bp, synthetic construct
  source 1..63: mol_type = other DNA
gactcgcagcctgtgatatcgcgcgcgcaataagcgcgcattattagcgatattattaatcac

SEQ ID NO: 1408 - DNA, 63 bp, synthetic construct
  source 1..63: mol_type = other DNA
gactcgcagcctgtgcatacgcgcgcgcaataagcgcgcattattagcgtaattattatgcac

SEQ ID NO: 1409 - DNA, 63 bp, synthetic construct
  source 1..63: mol_type = other DNA
gactcgcagcctgtgcacacgcgcgcgcaataagcgcgcattattagcgtgattattatgcac

SEQ ID NO: 1410 - DNA, 63 bp, synthetic construct
  source 1..63: mol_type = other DNA
gactcgcagcccgggatatagcgcgcgcaataagcgcgcattattagctatattattaatccc

SEQ ID NO: 1411 - DNA, 63 bp, synthetic construct
  source 1..63: mol_type = other DNA
gactcgcagcccgggatatcgcgcgcgcaataagcgcgcattattagcgatattattaatccc

SEQ ID NO: 1412 - DNA, 63 bp, synthetic construct
  source 1..63: mol_type = other DNA
gactcgcagcccgggcatacgcgcgcgcaataagcgcgcattattagcgtaattattatgccc

SEQ ID NO: 1413 - DNA, 63 bp, synthetic construct
  source 1..63: mol_type = other DNA
gactcgcagcccgggcacacgcgcgcgcaataagcgcgcattattagcgtgattattatgccc

SEQ ID NO: 1414 - DNA, 87 bp, synthetic construct
  source 1..87: mol_type = other DNA
gactcgcagcctgtgatatagcgcgcgcaataagcgcgcattattagctatattattaatcacattattaaggctattattagcgag

SEQ ID NO: 1415 - DNA, 87 bp, synthetic construct
  source 1..87: mol_type = other DNA
gactcgcagcctgtgatatcgcgcgcgcaataagcgcgcattattagcgatattattaatcacattattaaggctattattagcgag

SEQ ID NO: 1416 - DNA, 87 bp, synthetic construct
  source 1..87: mol_type = other DNA
gactcgcagcctgtgcatacgcgcgcgcaataagcgcgcattattagcgtaattattatgcacattattaaggctattattagcgag

SEQ ID NO: 1417 - DNA, 87 bp, synthetic construct
  source 1..87: mol_type = other DNA
gactcgcagcctgtgcacacgcgcgcgcaataagcgcgcattattagcgtgattattatgcacattattaaggctattattagcgag

SEQ ID NO: 1418 - DNA, 87 bp, synthetic construct
  source 1..87: mol_type = other DNA
gactcgcagcccgggatatagcgcgcgcaataagcgcgcattattagctatattattaatcccattattagggctattattagcgag

SEQ ID NO: 1419 - DNA, 87 bp, synthetic construct
  source 1..87: mol_type = other DNA
gactcgcagcccgggatatcgcgcgcgcaataagcgcgcattattagcgatattattaatcccattattagggctattattagcgag

SEQ ID NO: 1420 - DNA, 87 bp, synthetic construct
  source 1..87: mol_type = other DNA
gactcgcagcccgggcatacgcgcgcgcaataagcgcgcattattagcgtaattattatgcccattattagggctattattagcgag

SEQ ID NO: 1421 - DNA, 87 bp, synthetic construct
  source 1..87: mol_type = other DNA
gactcgcagcccgggcacacgcgcgcgcaataagcgcgcattattagcgtgattattatgcccattattagggctattattagcgag

What is claimed is:

1. A polyribonucleotide encoding a payload comprising a polypeptide, wherein the polyribonucleotide comprises a modified ribonucleotide having a nucleoside comprising an acetyl group, wherein the nucleoside is N4-acetylcytidine and the modified ribonucleotide has:
   (a) a 5' monophosphate;
   (b) a 5' diphosphate; or
   (c) a 5' triphosphate and a structure of:

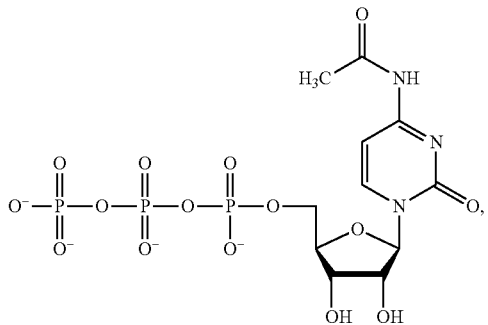

wherein the polyribonucleotide comprises cytidine residues and at least 25% of the cytidine residues comprise N4-acetylcytidine.

2. The polyribonucleotide of claim 1, wherein:
   less than 100% of cytidine residues in the polyribonucleotide comprise N4-acetylcytidine.

3. The polyribonucleotide of claim 1, wherein the polyribonucleotide further comprises one or more modified ribonucleotides other than N4-acetylcytidine.

4. The polyribonucleotide of claim 3, wherein the one or more modified ribonucleotides is 5-hydroxymethyluridine, and the modified ribonucleotide has:
   (a) a 5' monophosphate;
   (b) a 5' diphosphate; or
   (c) a 5' triphosphate and a structure of:

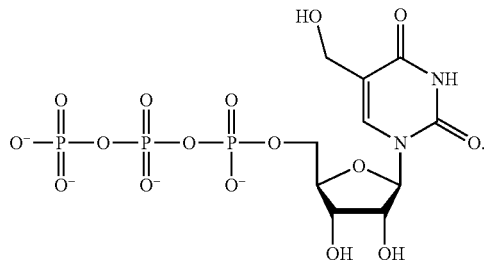

5. The polyribonucleotide of claim 1, characterized in that when assessed in a cell, tissue or an organism that has been administered the polyribonucleotide:
   (a) reduced immunogenicity is observed relative to an appropriate reference comparator,
   (b) increased cell viability is observed relative to an appropriate reference comparator, or
   (c) both (a) and (b).

6. A polyribonucleotide encoding a payload comprising a polypeptide, wherein the polyribonucleotide comprises a modified ribonucleotide having a nucleoside comprising a hydroxymethyl group, wherein the nucleoside is 5-hydroxymethyluridine and the modified ribonucleotide has:

(a) a 5' monophosphate;
(b) a 5' diphosphate; or
(c) a 5' triphosphate and a structure of:

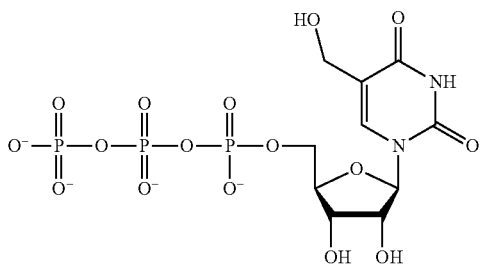

wherein the polyribonucleotide comprises uridine residues and at least 25% of the uridine residues comprise 5-hydroxymethyluridine.

7. The polyribonucleotide of claim 6, wherein
(i) less than 100% of uridine residues in the polyribonucleotide comprise 5-hydroxymethyluridine;
(ii) more than 60% of uridine residues in the polyribonucleotide comprise 5-hydroxymethyluridine; or
(iii) a combination thereof.

8. The polyribonucleotide of claim 6, wherein the polyribonucleotide further comprises one or more modified ribonucleotides other than 5-hydroxymethyluridine.

9. The polyribonucleotide of claim 8, wherein the one or more modified ribonucleotides is N4-acetylcytidine and the modified ribonucleotide has:
(a) a 5' monophosphate;
(b) a 5' diphosphate; or
(c) a 5' triphosphate and a structure of:

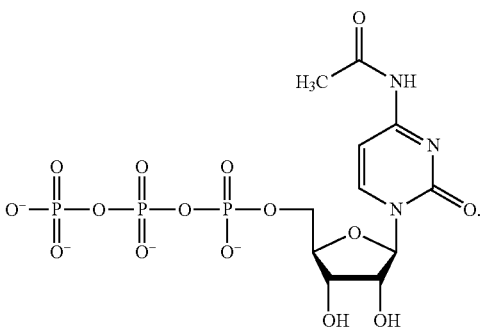

10. The polyribonucleotide of claim 6, characterized in that when assessed in a cell, tissue, or organism that has been administered the polyribonucleotide:
(a) reduced immunogenicity is observed relative to an appropriate reference comparator,
(b) increased cell viability is observed relative to an appropriate reference comparator,
(c) increased expression of the payload is observed relative to an appropriate reference comparator, or
(d) a combination of (a)-(c).

11. The polyribonucleotide of claim 10, wherein reduced immunogenicity activation of an immune response comprises:
(i) reduced activation of pathways of NFkb, IRF, or other cytokines resulting from inflammation in the cell, tissue or organism; or (ii) reduced comprises reduced detection of uncapped RNA by a molecular sensor, wherein the molecular sensor is or comprises RIG-I;
(iii) both (i) and (ii).

12. The polyribonucleotide of 10, wherein reduced immunogenicity allows for:
(i) repeated dosing of the polyribonucleotide;
(ii) administration of a higher dose of the polyribonucleotide as compared to an appropriate reference comparator; or
(iii) both (i) and (ii).

13. The polyribonucleotide of claim 12, wherein the reference comparator comprises an otherwise similar cell, tissue or organism that has been administered a comparable polyribonucleotide that includes:
(i) fewer N4-acetylcytidine nucleosides;
(ii) fewer 5-hydroxymethyluridine nucleosides; or
(iii) or both (i) and (ii).

14. The polyribonucleotide of claim 10, wherein the increase in expression of the payload is about 1.2-fold to about 20 compared to the reference comparator.

15. A composition comprising the polyribonucleotide of claim 1.

16. The composition of claim 15, wherein the composition is a pharmaceutical composition comprising an immunogenic composition; a vaccine, a gene therapy, a chemotherapy, a protein replacement therapy, an immunotherapy, a cell engineering therapy, or a combination thereof.

17. A cell comprising a polyribonucleotide according to claim 1.

18. A composition comprising the polyribonucleotide of claim 6.

19. The composition of claim 18, wherein the composition is a pharmaceutical composition comprising an immunogenic composition; a vaccine, a gene therapy, a chemotherapy, a protein replacement therapy, an immunotherapy, a cell engineering therapy, or a combination thereof.

20. A cell comprising a polyribonucleotide according to claim 6.

21. A polyribonucleotide encoding a payload comprising a polypeptide, wherein the polyribonucleotide comprises a modified ribonucleotide comprising a nucleoside comprising:
(I) a hydroxymethyl group, wherein the nucleoside is 5-hydroxymethyluridine and the modified ribonucleotide has: (a) a 5' monophosphate; (b) a 5' diphosphate; or (c) a 5' triphosphate and a structure of:

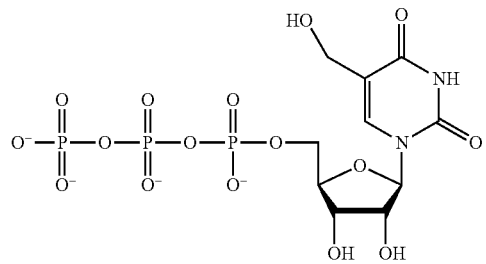

and
(II) an acetyl group, wherein the nucleoside is N4-acetylcytidine and the modified ribonucleotide has: (a) a 5' monophosphate; (b) a 5' diphosphate; or (c) a 5' triphosphate and a structure of:

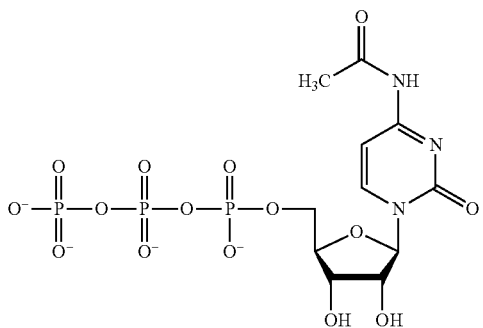

wherein the polyribonucleotide comprises:
(i) cytidine residues and at least 25% of the cytidine residues comprise N4-acetylcytidine; and
(ii) uridine residues and at least 25% the uridine residues comprise 5-hydroxymethyluridine.

22. The polyribonucleotide of claim 21, wherein:
(a) the polyribonucleotide comprises cytidine residues and at least 50% of cytidine residues in the polyribonucleotide comprise N4-acetylcytidine;
(b) the polyribonucleotide comprises uridine residues and at least 50% of uridine residues in the polyribonucleotide comprise 5-hydroxymethyluridine; or
(c) both (a) and (b).

23. The polyribonucleotide of claim 21, characterized in that when assessed in a cell, tissue, or organism that has been administered the polyribonucleotide:
(a) reduced immunogenicity is observed relative to an appropriate reference comparator,
(b) increased cell viability is observed relative to an appropriate reference comparator,
(c) increased expression of the payload is observed relative to an appropriate reference comparator, or
(d) a combination of (a)-(c).

24. The polyribonucleotide of claim 1, wherein at least 50% of the cytidine residues comprise N4-acetylcytidine.

25. The polyribonucleotide of claim 1, wherein at least 75% of the cytidine residues comprise N4-acetylcytidine.

26. The polyribonucleotide of claim 6, wherein at least 50% of the uridine residues comprise 5-hydroxymethyluridine.

27. The polyribonucleotide of claim 6, wherein at least 75% of the uridine residues comprise 5-hydroxymethyluridine.

28. The polyribonucleotide of claim 21, wherein:
(a) the polyribonucleotide comprises cytidine residues and at least 90% of cytidine residues in the polyribonucleotide comprise N4-acetylcytidine;
(b) the polyribonucleotide comprises uridine residues and at least 90% of uridine residues in the polyribonucleotide comprise 5-hydroxymethyluridine; or
(c) both (a) and (b).

29. The polyribonucleotide of claim 21, wherein 100% of the cytidine residues comprise N4-acetylcytidine and 100% of the uridine residues comprise 5-hydroxymethyluridine.

30. A composition comprising the polyribonucleotide of claim 21, wherein the composition is a pharmaceutical composition comprising an immunogenic composition; a vaccine, a gene therapy, a chemotherapy, a protein replacement therapy, an immunotherapy, a cell engineering therapy, or a combination thereof.

* * * * *

UNITED STATES PATENT AND TRADEMARK OFFICE
CERTIFICATE OF CORRECTION

| | | |
|---|---|---|
| PATENT NO. | : 11,639,501 B2 | Page 1 of 1 |
| APPLICATION NO. | : 17/736966 | |
| DATED | : May 2, 2023 | |
| INVENTOR(S) | : Nikhil Dhar et al. | |

It is certified that error appears in the above-identified patent and that said Letters Patent is hereby corrected as shown below:

In the Claims

In Claim 11, Column 81 at Line 63, please delete: "activation of an immune response"

In Claim 11, Column 82, at Line 1, please delete: "reduced comprises"

Signed and Sealed this
Thirty-first Day of October, 2023

*Katherine Kelly Vidal*

Katherine Kelly Vidal
*Director of the United States Patent and Trademark Office*